(12) United States Patent
Bacac et al.

(10) Patent No.: US 11,459,404 B2
(45) Date of Patent: Oct. 4, 2022

(54) BISPECIFIC T CELL ACTIVATING ANTIGEN BINDING MOLECULES

(71) Applicant: Roche Glycart AG, Schlieren (CH)

(72) Inventors: Marina Bacac, Zurich (CH); Peter Bruenker, Hittnau (CH); Christiane Neumann, Niederweningen (CH); Christian Klein, Bonstetten (CH); Ekkehard Moessner, Kreuzlingen (CH); Pablo Umana, Wollerau (CH); Tina Weinzierl, Schlieren (CH)

(73) Assignee: Roche Glycart AG, Schlieren (CH)

( * ) Notice: Subject to any disclaimer, the term of this patent is extended or adjusted under 35 U.S.C. 154(b) by 321 days.

(21) Appl. No.: 15/655,689

(22) Filed: Jul. 20, 2017

(65) Prior Publication Data

US 2018/0086849 A1  Mar. 29, 2018

Related U.S. Application Data

(63) Continuation of application No. 14/835,439, filed on Aug. 25, 2015, now abandoned, which is a continuation of application No. PCT/EP2014/053378, filed on Feb. 21, 2014.

(30) Foreign Application Priority Data

Feb. 26, 2013 (EP) .................................. 13156674

(51) Int. Cl.
| C07K 16/46 | (2006.01) |
| C07K 16/28 | (2006.01) |
| C07K 16/32 | (2006.01) |
| C07K 16/30 | (2006.01) |
| A61K 39/00 | (2006.01) |

(52) U.S. Cl.
CPC ........ *C07K 16/468* (2013.01); *C07K 16/2809* (2013.01); *C07K 16/30* (2013.01); *C07K 16/3007* (2013.01); *C07K 16/3053* (2013.01); *C07K 16/32* (2013.01); *A61K 2039/505* (2013.01); *C07K 2317/24* (2013.01); *C07K 2317/31* (2013.01); *C07K 2317/35* (2013.01); *C07K 2317/52* (2013.01); *C07K 2317/60* (2013.01); *C07K 2317/64* (2013.01); *C07K 2317/66* (2013.01); *C07K 2317/71* (2013.01); *C07K 2317/73* (2013.01); *C07K 2317/732* (2013.01); *C07K 2317/92* (2013.01); *C07K 2318/20* (2013.01); *C07K 2319/00* (2013.01)

(58) Field of Classification Search
CPC ............ C07K 2319/00; C07K 2319/70; C07K 2319/74; C07K 2318/00–20; C07K 16/468; C07K 2317/31
See application file for complete search history.

(56) References Cited

U.S. PATENT DOCUMENTS

| 5,571,894 | A | 11/1996 | Wels et al. |
| 5,587,458 | A | 12/1996 | King et al. |
| 5,591,828 | A | 1/1997 | Bosslet et al. |
| 5,731,168 | A | 3/1998 | Carter et al. |
| 5,821,337 | A | 10/1998 | Carter et al. |
| 5,869,046 | A | 2/1999 | Presta et al. |
| 6,248,516 | B1 | 6/2001 | Winter et al. |
| 6,737,056 | B1 | 5/2004 | Presta |
| 6,809,185 | B1 | 10/2004 | Schoonjans et al. |
| 7,332,581 | B2 | 2/2008 | Presta |
| 7,695,936 | B2 | 4/2010 | Carter et al. |
| 8,227,577 | B2 | 7/2012 | Klein et al. |
| 8,242,247 | B2 | 8/2012 | Klein et al. |
| 8,703,132 | B2 | 4/2014 | Imhof-Jung et al. |
| 8,709,421 | B2 | 4/2014 | Heiss et al. |
| 8,796,424 | B2 | 8/2014 | Croasdale et al. |
| 8,969,526 | B2 | 3/2015 | Baehner et al. |
| 9,068,008 | B2 | 6/2015 | Mossner et al. |
| 9,079,965 | B2 | 7/2015 | Zhou et al. |
| 9,266,938 | B2 | 2/2016 | Ast et al. |
| 9,266,967 | B2 | 2/2016 | Klein et al. |
| 9,382,323 | B2 | 7/2016 | Brinkmann et al. |
| 9,447,159 | B2 | 9/2016 | Ast et al. |
| 9,526,797 | B2 | 12/2016 | Gerdes et al. |
| 2002/0004587 | A1 | 1/2002 | Miller et al. |
| 2007/0111281 | A1 | 5/2007 | Sondermann et al. |
| 2008/0241152 | A1 | 10/2008 | Alitalo et al. |
| 2009/0252683 | A1 | 10/2009 | Kischel et al. |
| 2010/0015133 | A1 | 1/2010 | Igawa et al. |
| 2010/0150918 | A1 | 6/2010 | Kufer et al. |
| 2010/0239582 | A1 | 9/2010 | Humphreys et al. |
| 2010/0254988 | A1 | 10/2010 | Bossenmaier et al. |
| 2010/0316645 | A1 | 12/2010 | Imhof-Jung et al. |

(Continued)

FOREIGN PATENT DOCUMENTS

| CN | 101896504 A | 11/2010 |
| CN | 101903406 A | 12/2010 |
| CN | 102448985 A | 5/2012 |
| CN | 102549018 A | 7/2012 |

(Continued)

OTHER PUBLICATIONS

Atwell et al., "Stable heterodimers from remodeling the domain interface of a homodimer using a phage display library," J Mol Biol. 270(1):26-35 (1997).

(Continued)

*Primary Examiner* — Jessica H Roark
(74) *Attorney, Agent, or Firm* — Clark & Elbing LLP; Karen L. Elbing

(57) ABSTRACT

The present invention generally relates to bispecific antigen binding molecules for T cell activation and re-direction to specific target cells. In addition, the present invention relates to polynucleotides encoding such bispecific antigen binding molecules, and vectors and host cells comprising such polynucleotides. The invention further relates to methods for producing the bispecific antigen binding molecules of the invention, and to methods of using these bispecific antigen binding molecules in the treatment of disease.

1 Claim, 131 Drawing Sheets

Specification includes a Sequence Listing.

(56) References Cited

U.S. PATENT DOCUMENTS

| | | | |
|---|---|---|---|
| 2011/0293613 A1 | 12/2011 | Brinkmann et al. | |
| 2012/0225071 A1 | 9/2012 | Klein et al. | |
| 2012/0251531 A1 | 10/2012 | Baehner et al. | |
| 2012/0276125 A1 | 11/2012 | Ast et al. | |
| 2012/0309940 A1* | 12/2012 | Fischer | C07K 16/00 530/387.3 |
| 2012/0321626 A1* | 12/2012 | Zhou | A61P 43/00 424/136.1 |
| 2013/0022601 A1 | 1/2013 | Brinkmann et al. | |
| 2013/0058936 A1 | 3/2013 | Bruenker et al. | |
| 2013/0058937 A1 | 3/2013 | Auer et al. | |
| 2013/0060011 A1 | 3/2013 | Bruenker et al. | |
| 2013/0078249 A1 | 3/2013 | Ast et al. | |
| 2013/0171095 A1 | 7/2013 | Bernett et al. | |
| 2014/0088295 A1 | 3/2014 | Smith et al. | |
| 2014/0112914 A1 | 4/2014 | Nezu et al. | |
| 2014/0154254 A1 | 6/2014 | Kannan et al. | |
| 2014/0242079 A1 | 8/2014 | Bacac et al. | |
| 2014/0242080 A1 | 8/2014 | Jaeger et al. | |
| 2014/0288275 A1 | 9/2014 | Moore et al. | |
| 2014/0294823 A1 | 10/2014 | Moore et al. | |
| 2014/0294833 A1 | 10/2014 | Desjarlais et al. | |
| 2014/0302064 A1 | 10/2014 | Moore | |
| 2014/0322217 A1 | 10/2014 | Moore et al. | |
| 2014/0363426 A1 | 12/2014 | Moore et al. | |
| 2014/0370013 A1 | 12/2014 | Desjarlais et al. | |
| 2014/0377270 A1 | 12/2014 | Moore et al. | |
| 2015/0166661 A1 | 6/2015 | Chen et al. | |
| 2015/0274845 A1 | 10/2015 | Bruenker et al. | |
| 2015/0315296 A1 | 11/2015 | Schaefer et al. | |
| 2016/0075785 A1 | 3/2016 | Ast et al. | |
| 2016/0130347 A1 | 5/2016 | Bruenker et al. | |
| 2016/0145354 A1 | 5/2016 | Bacac et al. | |
| 2016/0175397 A1 | 6/2016 | Umana et al. | |
| 2016/0208017 A1 | 7/2016 | Ast et al. | |
| 2016/0208019 A1 | 7/2016 | Bacac et al. | |
| 2016/0263240 A1 | 9/2016 | Ast et al. | |
| 2016/0368985 A1 | 12/2016 | Hotzel et al. | |
| 2017/0008971 A1 | 1/2017 | Dennis et al. | |
| 2017/0096485 A1 | 4/2017 | Bacac et al. | |
| 2017/0096495 A1 | 4/2017 | Bacac et al. | |
| 2017/0114146 A1 | 4/2017 | Klein et al. | |
| 2017/0174786 A1 | 6/2017 | Bacac et al. | |
| 2017/0190783 A1 | 7/2017 | Bacac et al. | |
| 2017/0209573 A1 | 7/2017 | Bacac et al. | |
| 2017/0253670 A1 | 9/2017 | Klein et al. | |
| 2017/0267783 A1 | 9/2017 | Nezu et al. | |

FOREIGN PATENT DOCUMENTS

| | | |
|---|---|---|
| EP | 0404097 B1 | 9/1996 |
| EP | 1870459 A1 | 12/2007 |
| EP | 1870459 A4 | 9/2010 |
| EP | 2578230 A1 | 4/2013 |
| EP | 2647707 A1 | 10/2013 |
| EP | 2647707 A4 | 4/2014 |
| EP | 1870459 B1 | 6/2016 |
| JP | 2009-500018 A | 1/2009 |
| JP | 2010-538012 A | 12/2010 |
| JP | 2012-522523 A | 9/2012 |
| JP | 2012-528092 A | 11/2012 |
| JP | 2013-505223 A | 2/2013 |
| RU | 2426743 C2 | 8/2011 |
| WO | WO-91/03493 A1 | 3/1991 |
| WO | WO-93/16185 A2 | 8/1993 |
| WO | WO-96/01126 A1 | 1/1996 |
| WO | WO-96/27011 A1 | 9/1996 |
| WO | WO-96/40210 A1 | 12/1996 |
| WO | WO-98/50431 A2 | 11/1998 |
| WO | WO-98/50431 A3 | 1/1999 |
| WO | WO-02/09573 A2 | 2/2002 |
| WO | WO-2005/044859 A2 | 5/2005 |
| WO | WO-2005/087812 A1 | 9/2005 |
| WO | WO-2006/082515 A2 | 8/2006 |
| WO | WO-2007/005608 A2 | 1/2007 |
| WO | WO-2007/024715 A2 | 3/2007 |
| WO | WO-2007/042261 A2 | 4/2007 |
| WO | WO-2007/071426 A1 | 6/2007 |
| WO | WO-2007/075270 A2 | 7/2007 |
| WO | WO-2007/095338 A2 | 8/2007 |
| WO | WO-2007/110205 A2 | 10/2007 |
| WO | WO-2007/146968 A2 | 12/2007 |
| WO | WO-2007/147901 A1 | 12/2007 |
| WO | WO-2007/024715 A3 | 10/2008 |
| WO | WO-2008/119566 A2 | 10/2008 |
| WO | WO-2008/119567 A2 | 10/2008 |
| WO | WO-2009/032782 A2 | 3/2009 |
| WO | WO-2007/024715 A9 | 4/2009 |
| WO | WO-2009/068649 A2 | 6/2009 |
| WO | WO-2009/070642 A1 | 6/2009 |
| WO | WO-2009/080251 A1 | 7/2009 |
| WO | WO-2009/080252 A1 | 7/2009 |
| WO | WO-2009/080253 A1 | 7/2009 |
| WO | WO-2009/080254 A1 | 7/2009 |
| WO | WO-2009/089004 A1 | 7/2009 |
| WO | WO-2010/115551 A1 | 10/2010 |
| WO | WO-2010/115589 A1 | 10/2010 |
| WO | WO-2010/129304 A2 | 11/2010 |
| WO | WO-2010/136172 A1 | 12/2010 |
| WO | WO-2010/145792 A1 | 12/2010 |
| WO | WO-2010/145793 A1 | 12/2010 |
| WO | WO-2010/129304 A3 | 2/2011 |
| WO | WO-2011/028952 A1 | 3/2011 |
| WO | WO-2011/033105 A1 | 3/2011 |
| WO | WO-2011/036460 A1 | 3/2011 |
| WO | WO-2011/054519 A1 | 5/2011 |
| WO | WO-2011/090754 A1 | 7/2011 |
| WO | WO-2011/090762 A1 | 7/2011 |
| WO | WO-2011/143545 A1 | 11/2011 |
| WO | WO-2012/025530 A1 | 3/2012 |
| WO | WO-2012/058768 A1 | 5/2012 |
| WO | WO-2012/066058 A1 | 5/2012 |
| WO | WO-2012/058768 A8 | 6/2012 |
| WO | WO-2012/073985 A1 | 6/2012 |
| WO | WO-2012/130831 A1 | 10/2012 |
| WO | WO-2012/146628 A1 | 11/2012 |
| WO | WO-2012/158818 A2 | 11/2012 |
| WO | WO-2012/162067 A2 | 11/2012 |
| WO | WO-2013/026831 A1 | 2/2013 |
| WO | WO-2013/026833 A1 | 2/2013 |
| WO | WO-2013/026837 A1 | 2/2013 |
| WO | WO-2013/096291 A2 | 6/2013 |
| WO | WO-2013/157953 A1 | 10/2013 |
| WO | WO-2013/157954 A1 | 10/2013 |
| WO | WO-2014/022540 A1 | 2/2014 |
| WO | WO-2014/028560 A2 | 2/2014 |
| WO | WO-2014/047231 A1 | 3/2014 |
| WO | WO-2014/028560 A3 | 5/2014 |
| WO | WO-2014/081955 A1 | 5/2014 |
| WO | WO-2014/122251 A2 | 8/2014 |
| WO | WO-2014/141152 A2 | 9/2014 |
| WO | WO-2014/153002 A1 | 9/2014 |
| WO | WO-2014/122251 A3 | 10/2014 |
| WO | WO-2014/141152 A3 | 12/2014 |
| WO | WO-2014/191113 A1 | 12/2014 |
| WO | WO-2014/191113 A8 | 2/2015 |
| WO | WO-2015/150447 A1 | 10/2015 |
| WO | WO-2016/020065 A1 | 2/2016 |
| WO | WO-2016/036678 A1 | 3/2016 |
| WO | WO-2016/079081 A1 | 5/2016 |
| WO | WO-2016/179003 A1 | 11/2016 |

OTHER PUBLICATIONS

Booy et al., "Monoclonal and bispecific antibodies as novel therapeutics," Arch Immunol Ther Exp (Warsz). 54(2):85-101 (2006).

Bosch et al., "MCSP/CD3-bispecific single-chain antibody construct engages CD4+ and CD8+ T cells for lysis of MCSP-expressing human uveal melanoma cells," AACR 101st Annual Meeting. Apr. 17-21, Washington, DC. 70(8 Suppl) Abstract 5621 (2010).

(56) References Cited

OTHER PUBLICATIONS

Carter, "Bispecific human IgG by design," J Immunol Methods. 248(1-2):7-15 (2001).
Chan et al., "Variable region domain exchange in human IgGs promotes antibody complex formation with accompanying structural changes and altered effector functions," Mol Immunol. 41(5):527-38 (2004).
Edelman et al., "The covalent structure of an entire gammaG immunoglobulin molecule," Proc Natl Acad Sci U S A. 63(1):78-85 (1969).
Holliger et al., "'Diabodies': small bivalent and bispecific antibody fragments," Proc Natl Acad Sci U S A. 90(14):6444-8 (1993).
Holliger et al., "Specific killing of lymphoma cells by cytotoxic T-cells mediated by a bispecific diabody," Protein Eng. 9(3):299-305 (1996).
Honeychurch et al., "Bispecific Ab therapy of B-cell lymphoma: target cell specificity of antibody derivatives appears critical in determining therapeutic outcome," Cancer Immunol Immunother. 45(3-4):171-3 (1997).
Hudson et al., "Engineered antibodies," Nat Med. 9(1):129-34 (2003).
Kipriyanov et al., "Bispecific tandem diabody for tumor therapy with improved antigen binding and pharmacokinetics," J Mol Biol. 293(1):41-56 (1999).
Klein et al., "Progress in overcoming the chain association issue in bispecific heterodimeric IgG antibodies," MAbs. 4(6):653-63 (2012).
Kontermann, "Dual targeting strategies with bispecific antibodies," MAbs. 4(2):182-97 (2012).
Merchant et al., "An efficient route to human bispecific IgG," Nat Biotechnol. 16(7):677-81 (1998).
Miller et al., "Design, construction, and in vitro analyses of multivalent antibodies," J Immunol. 170(9):4854-61 (2003).
Moore et al., "A novel bispecific antibody format enables simultaneous bivalent and monovalent co-engagement of distinct target antigens," MAbs. 3(6):546-57 (2011).
Moore et al., "Application of dual affinity retargeting molecules to achieve optimal redirected T-cell killing of B-cell lymphoma," Blood. 117(17):4542-51 (2011) (11 pages).
Muda et al., "Therapeutic assessment of SEED: a new engineered antibody platform designed to generate mono- and bispecific antibodies," Protein Eng Des Sel. 24(5):447-54 (2011).
Nagorsen et al., "Immunomodulatory therapy of cancer with T cell-engaging BiTE antibody blinatumomab," Exp Cell Res. 317(9):1255-60 (2011).
Oshimi et al., "Increased lysis of patient CD10-positive leukemic cells by T cells coated with anti-CD3 Fab' antibody cross-linked to anti-CD10 Fab' antibody," Blood. 77(5):1044-9 (1991).
Pessano et al., "The T3/T cell receptor complex: antigenic distinction between the two 20-kd T3 (T3-delta and T3-epsilon) subunits," EMBO J. 4(2):337-44 (1985).
Ridgway et al., "'Knobs-into-holes' engineering of antibody CH3 domains for heavy chain heterodimerization," Protein Eng. 9(7):617-21 (1996).
Riedle et al., "In vivo activation and expansion of T cells by a bi-specific antibody abolishes metastasis formation of human melanoma cells in SCID mice," Int J Cancer. 75(6):908-18 (1998).
Schaefer et al., "Immunoglobulin domain crossover as a generic approach for the production of bispecific IgG antibodies," Proc Natl Acad Sci U S A. 108(27):11187-92 (2011).
Seimetz et al., "Development and approval of the trifunctional antibody catumaxomab (anti-EpCAM x anti-CD3) as a targeted cancer immunotherapy," Cancer Treat Rev. 36(6):458-67 (2010).
Stubenrauch et al., "Impact of molecular processing in the hinge region of therapeutic IgG4 antibodies on disposition profiles in cynomolgus monkeys," Drug Metab Dispos. 38(1):84-91 (2010).
Sun et al., "Anti-CD20/CD3 T cell-dependent bispecific antibody for the treatment of B cell malignancies," Sci Transl Med. 7(287):287ra70 (2015) (11 pages).
Torisu-Itakura et al., "Redirected lysis of human melanoma cells by a MCSP/CD3-bispecific BiTE antibody that engages patient-derived T cells," J Immunother. 34(8):597-605 (2011).
Tutt et al., "Trispecific F(ab')3 derivatives that use cooperative signaling via the TCR/CD3 complex and CD2 to activate and redirect resting cytotoxic T cells," J Immunol. 147(1):60-9 (1991).
Wolf et al., "BiTEs: bispecific antibody constructs with unique anti-tumor activity," Drug Discov Today. 10(18):1237-44 (2005).
Zhu et al., "Identification of heavy chain residues in a humanized anti-CD3 antibody important for efficient antigen binding and T cell activation," J Immunol. 155(4):1903-10 (1995).
International Search Report and Written Opinion for International Patent Application No. PCT/EP2014/053378, dated Jul. 7, 2014 (15 pages).
Gall et al., "T cells armed with anti-CD3 x anti-CD20 bispecific antibody enhance killing of CD20+ malignant B cells and bypass complement-mediated rituximab resistance in vitro," Exp Hematol. 33(4):452-9 (2005).
Reusch et al., "Effect of tetravalent bispecific CD19xCD3 recombinant antibody construct and CD28 costimulation on lysis of malignant B cells from patients with chronic lymphocytic leukemia by autologous T cells," Int J Cancer. 112(3):509-18 (2004).
English Translation of Notice of Reasons for Rejection for Japanese Patent Application No. 2015-558453, dated Dec. 11, 2017 (16 pages).
Ren et al., "Anti-HER-2 anti-CD3 bi-specific antibodies inhibit growth of HCT-116 colorectal carcinoma cells in vitro and in vivo," Asian Pac J Cancer Prev. 13(6):2795-8 (2012).
Zahnd et al., "A designed ankyrin repeat protein evolved to picomolar affinity to Her2," J Mol Biol. 369(4):1015-28 (2007).
Office Action for Russian Patent Application No. 2015140915, dated Mar. 22, 2018 (22 pages).

\* cited by examiner

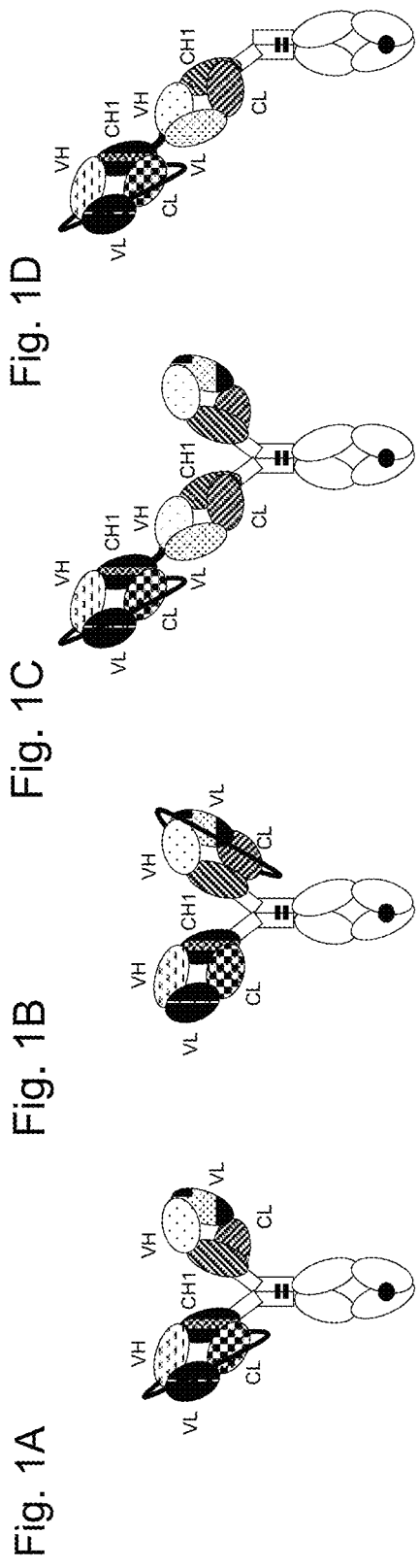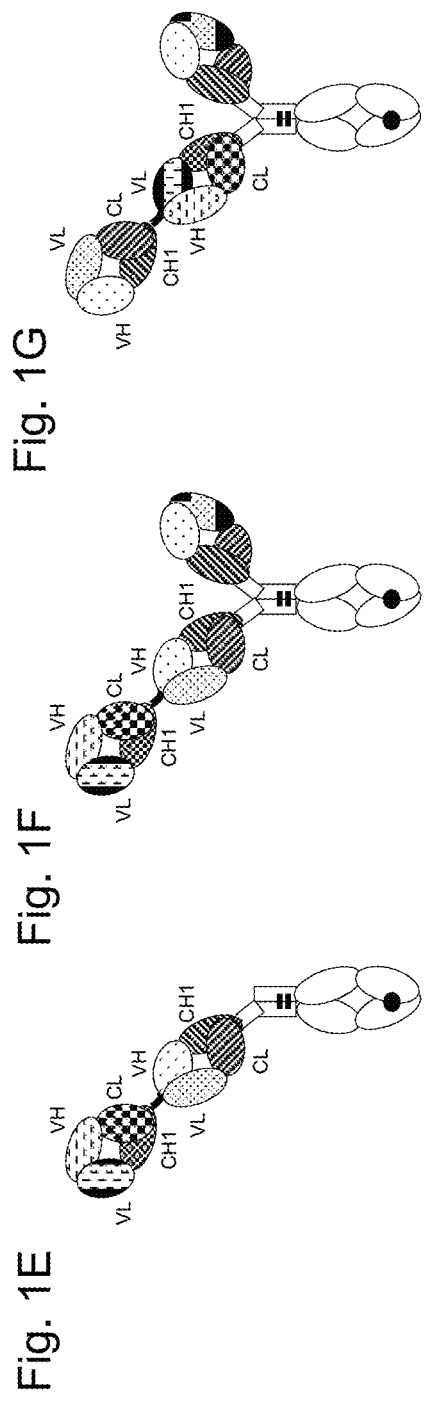

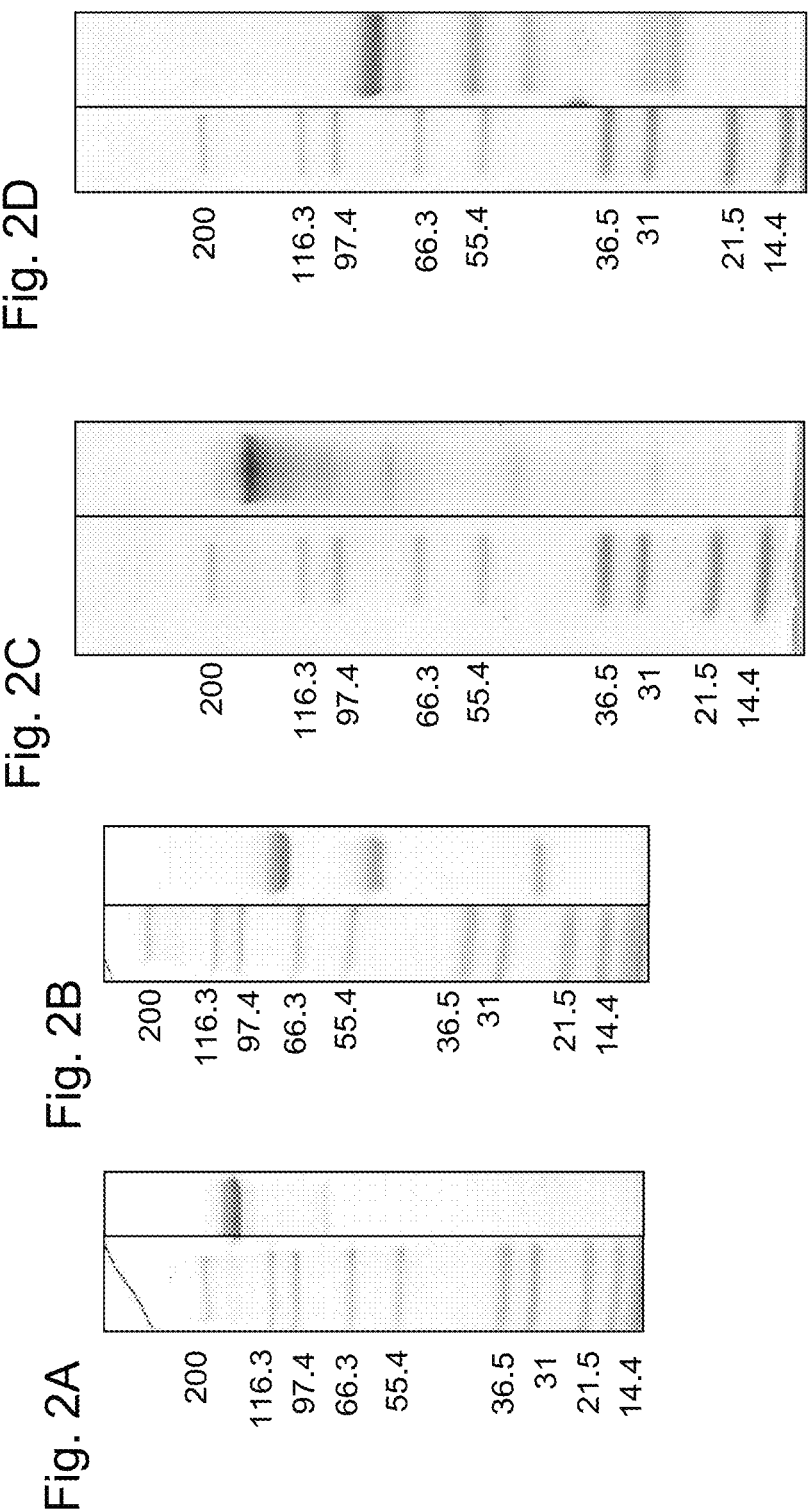

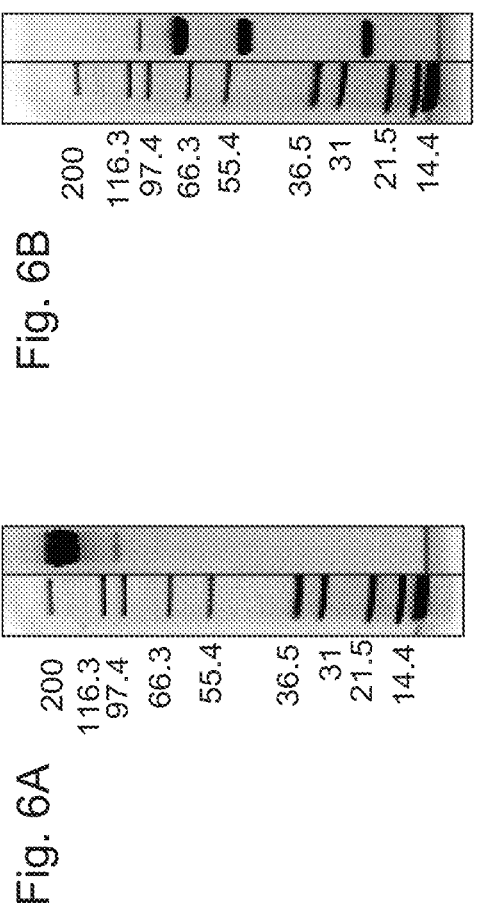
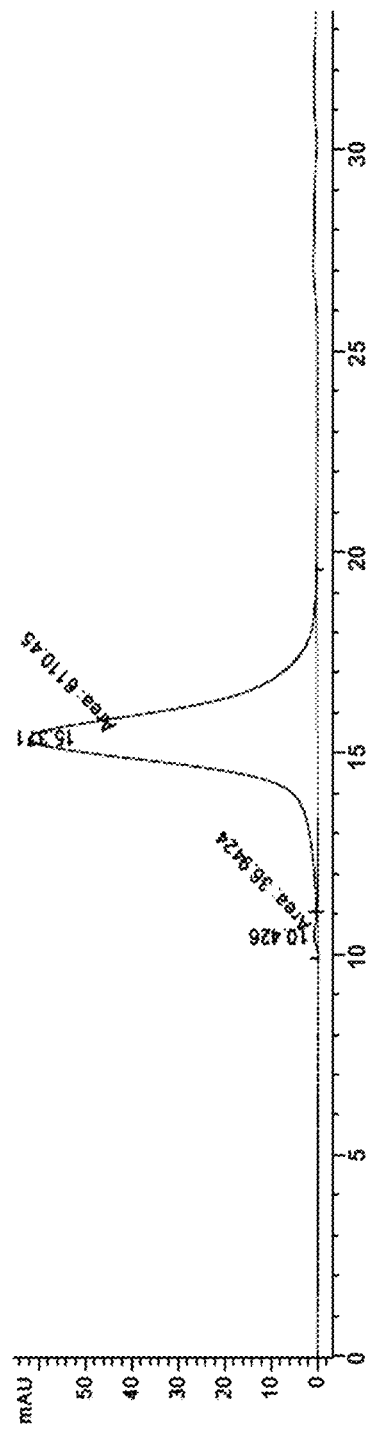
Fig. 6A
Fig. 6B
Fig. 6C

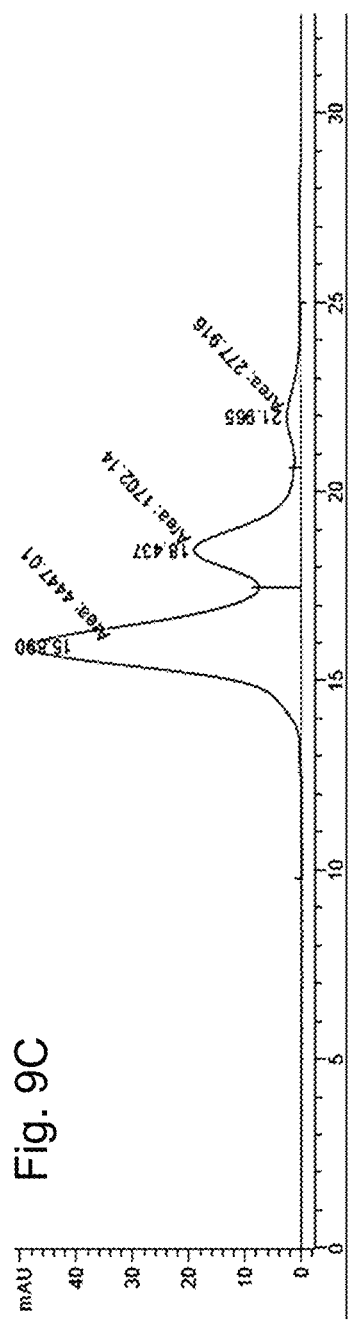
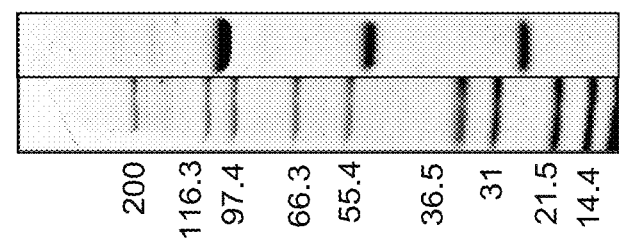
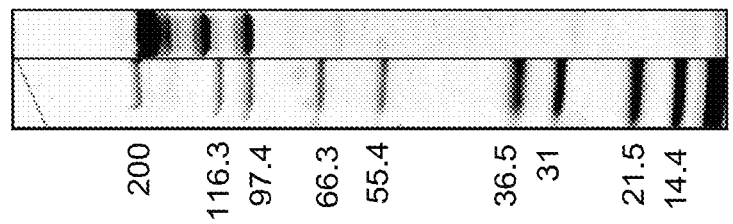

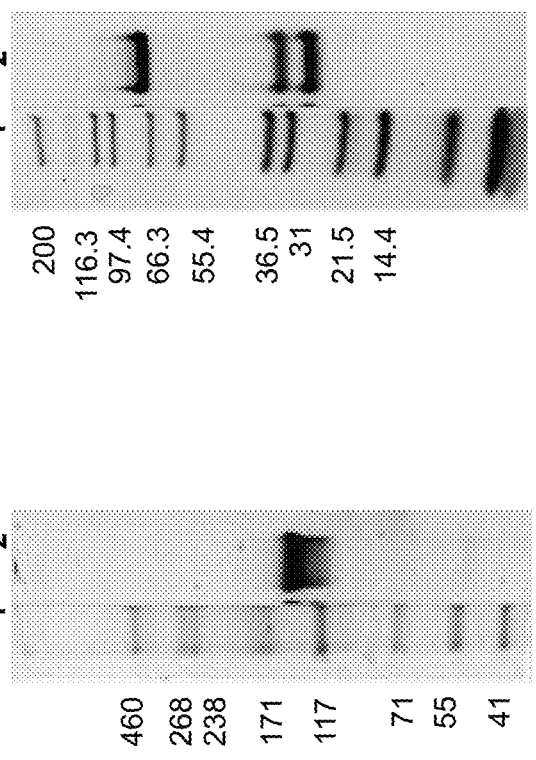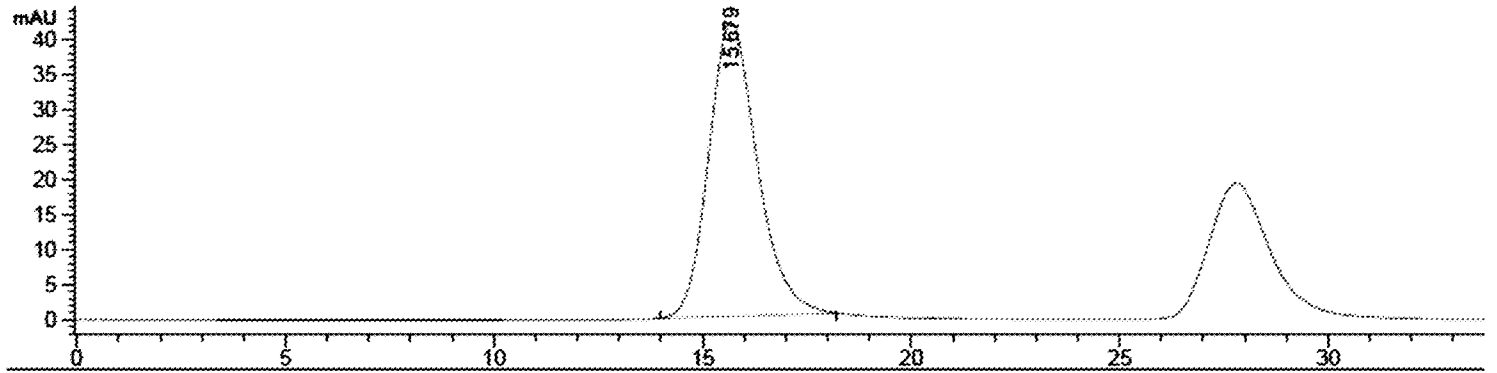
Fig. 11A
Fig. 11B
Fig. 11C

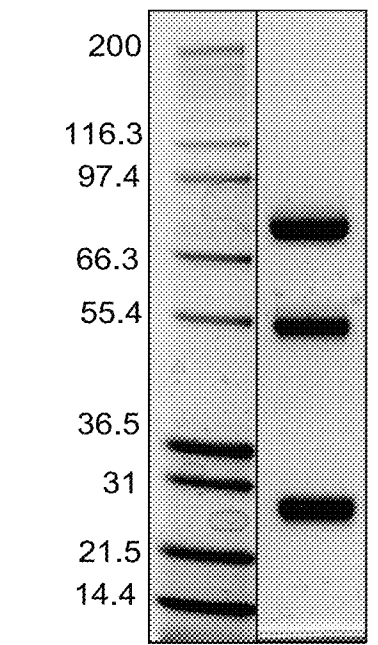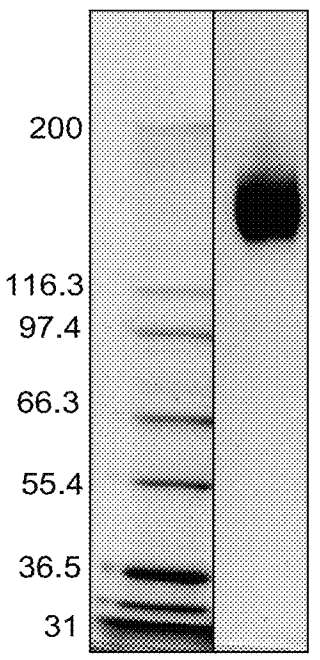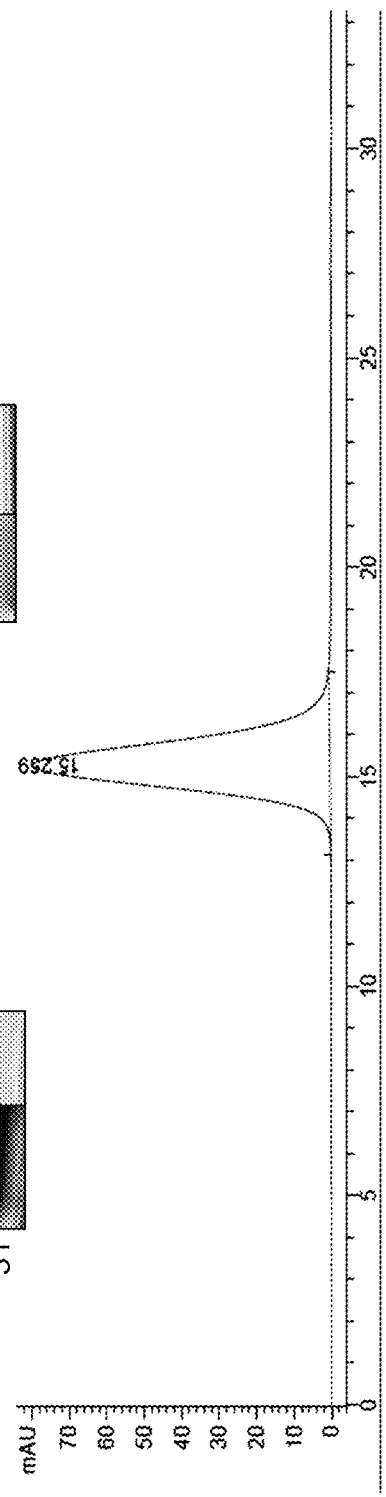
Fig. 12A
Fig. 12B
Fig. 12C

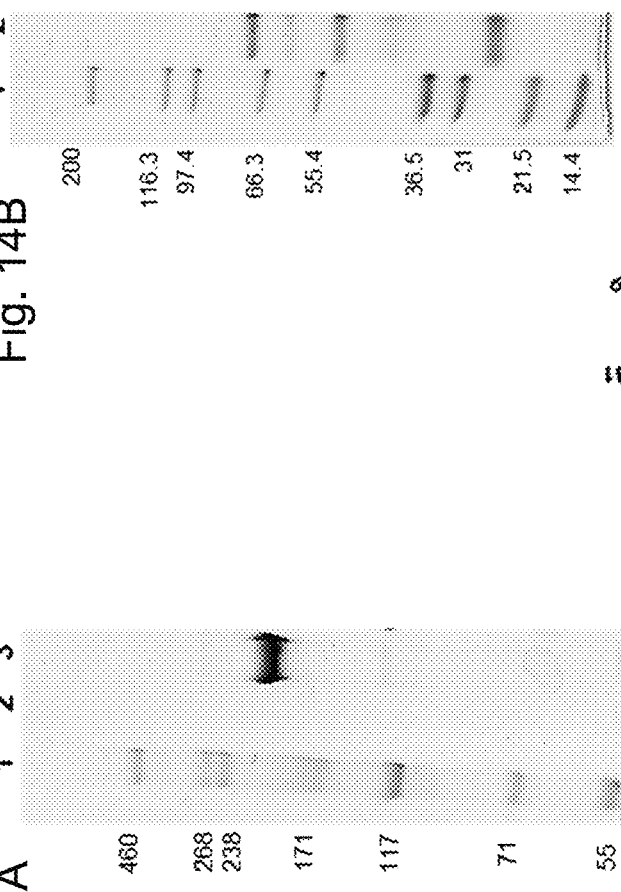
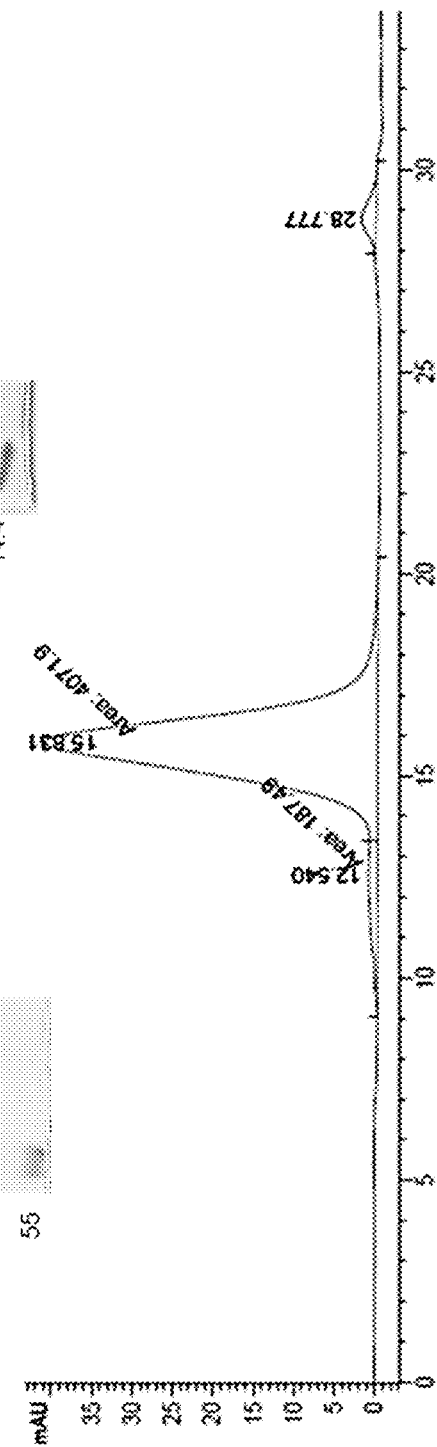
Fig. 14A
Fig. 14B
Fig. 14C

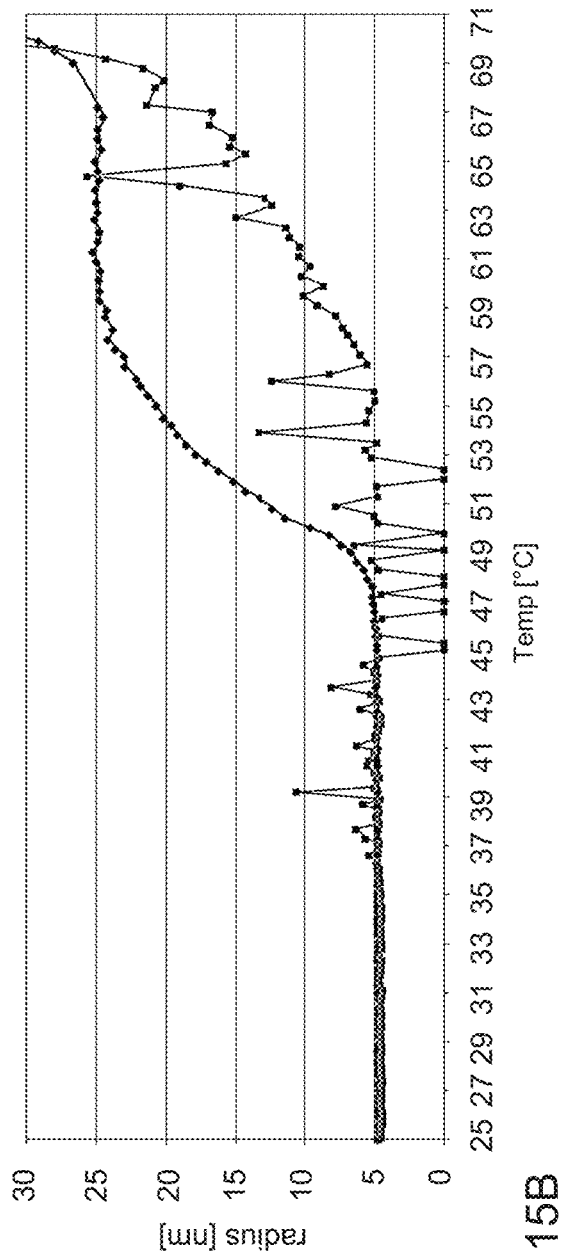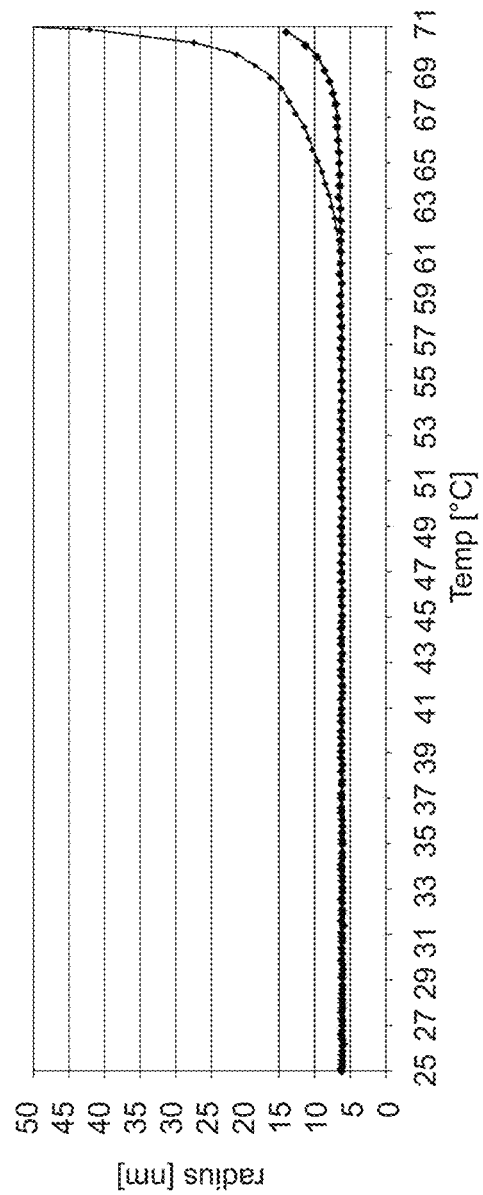

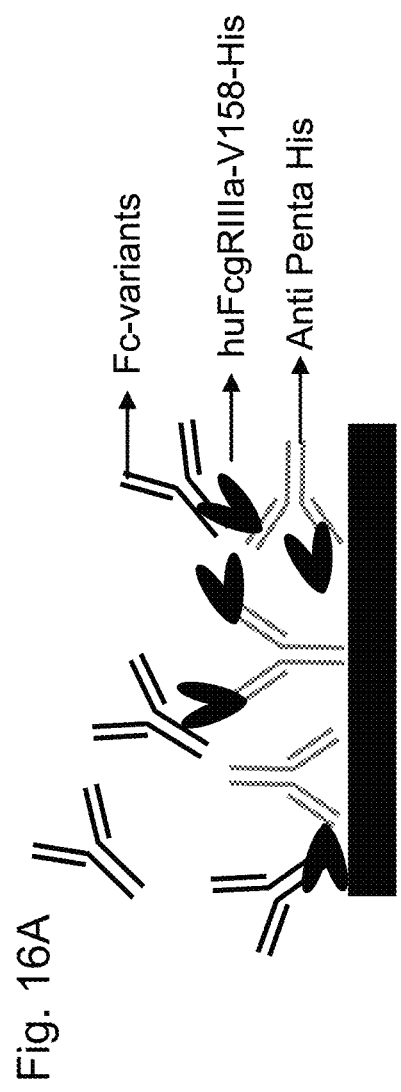
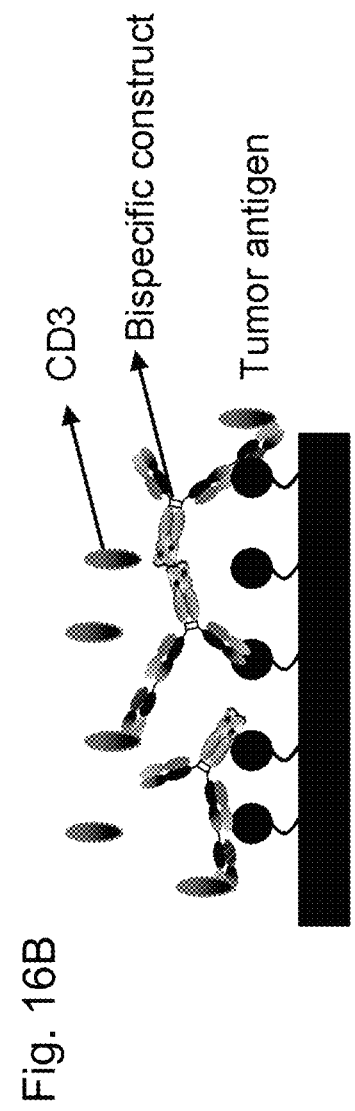

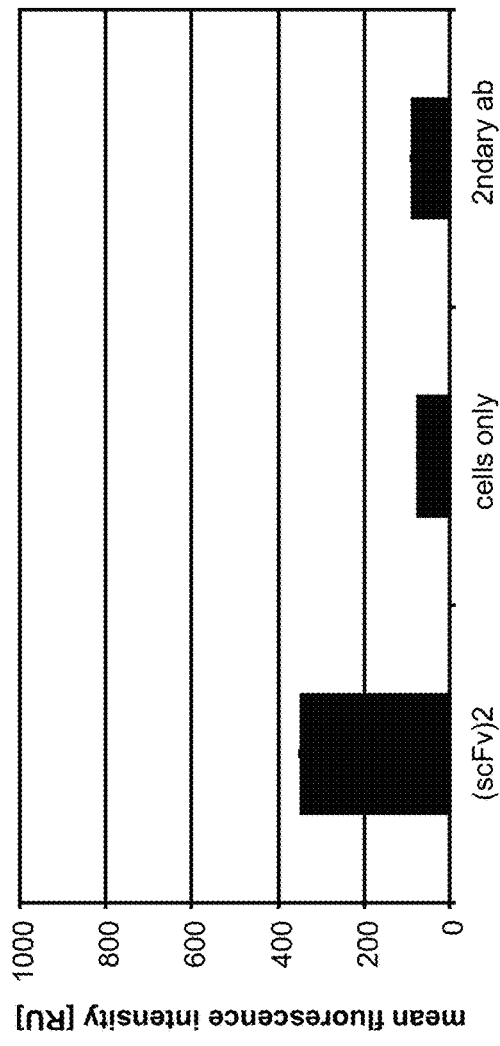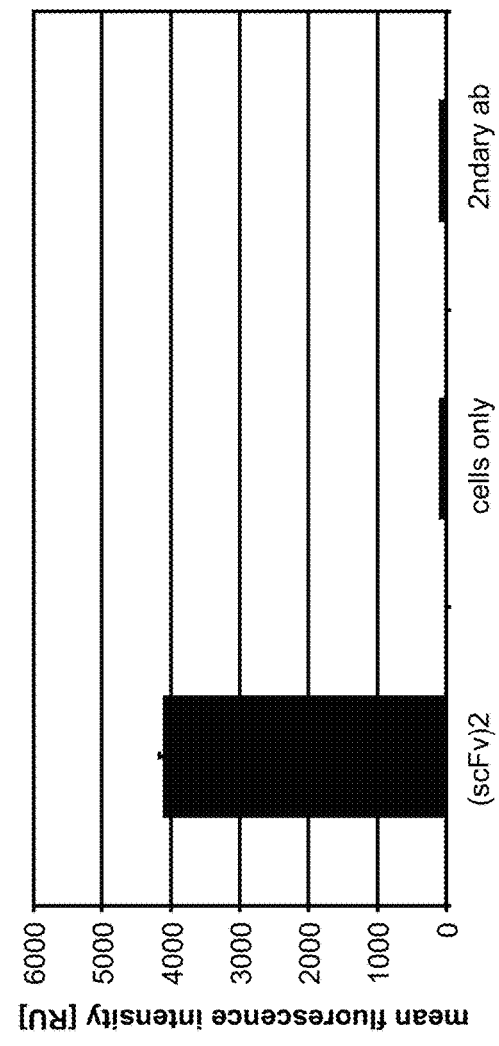

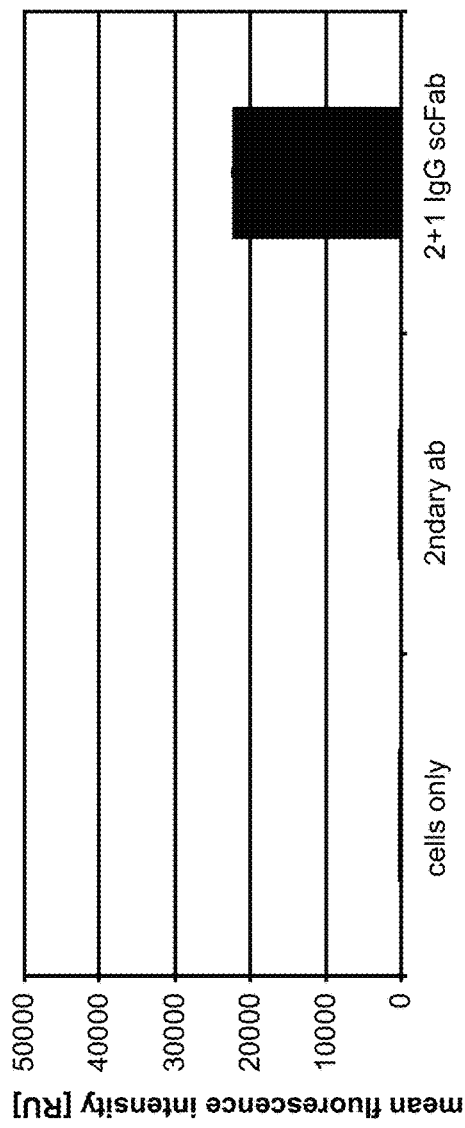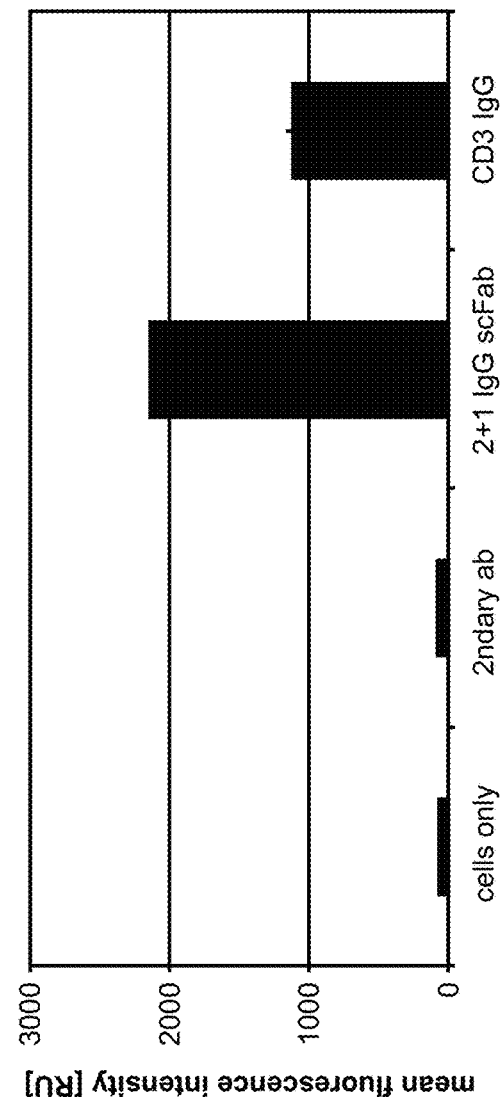

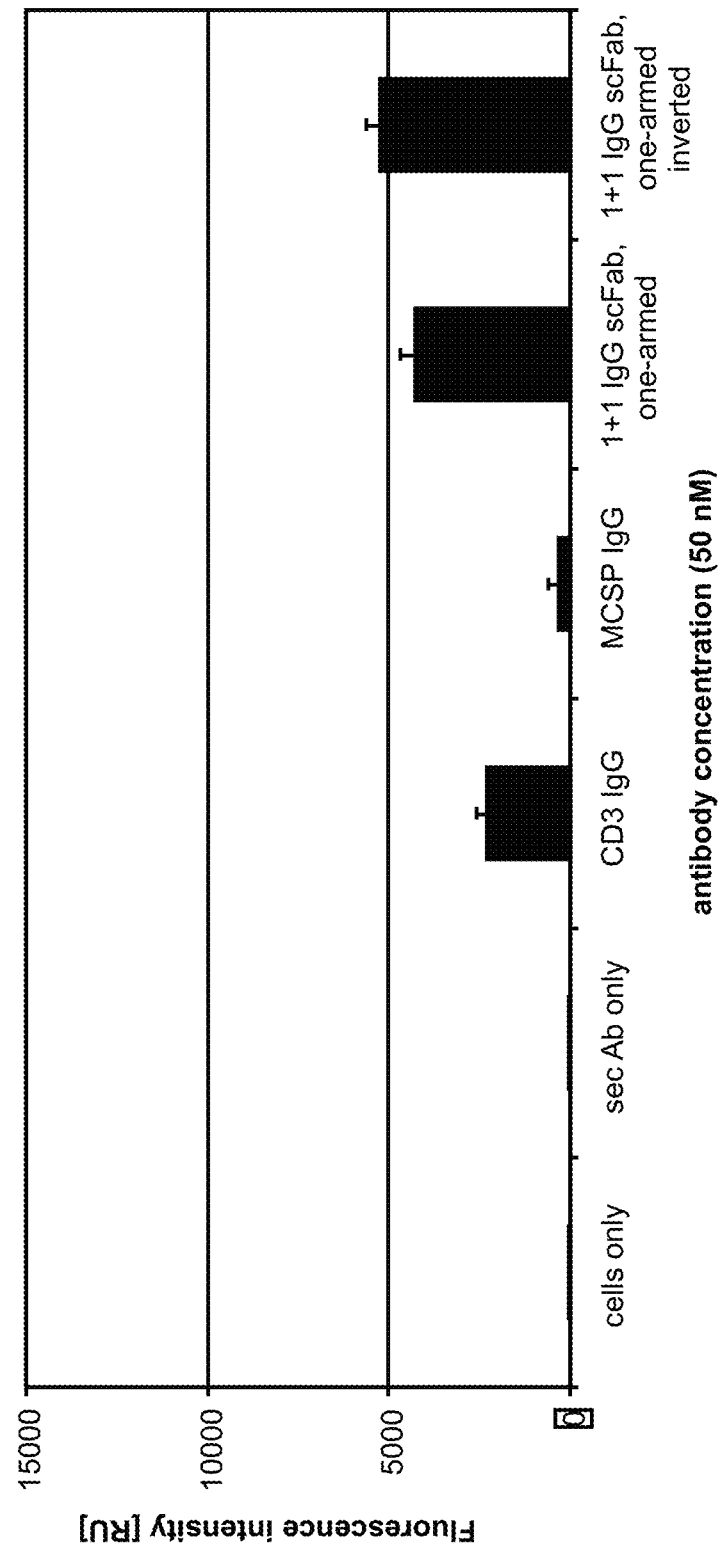

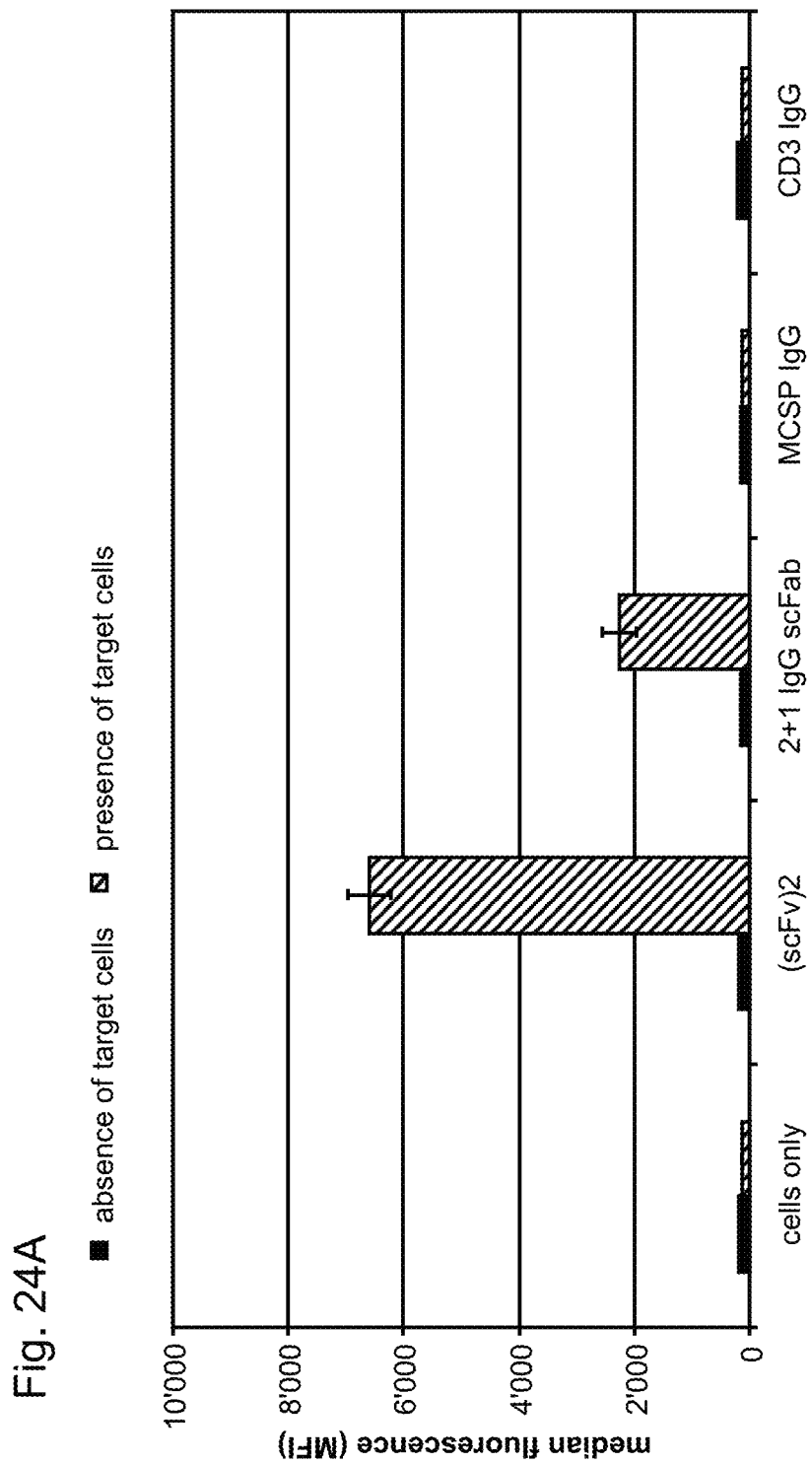

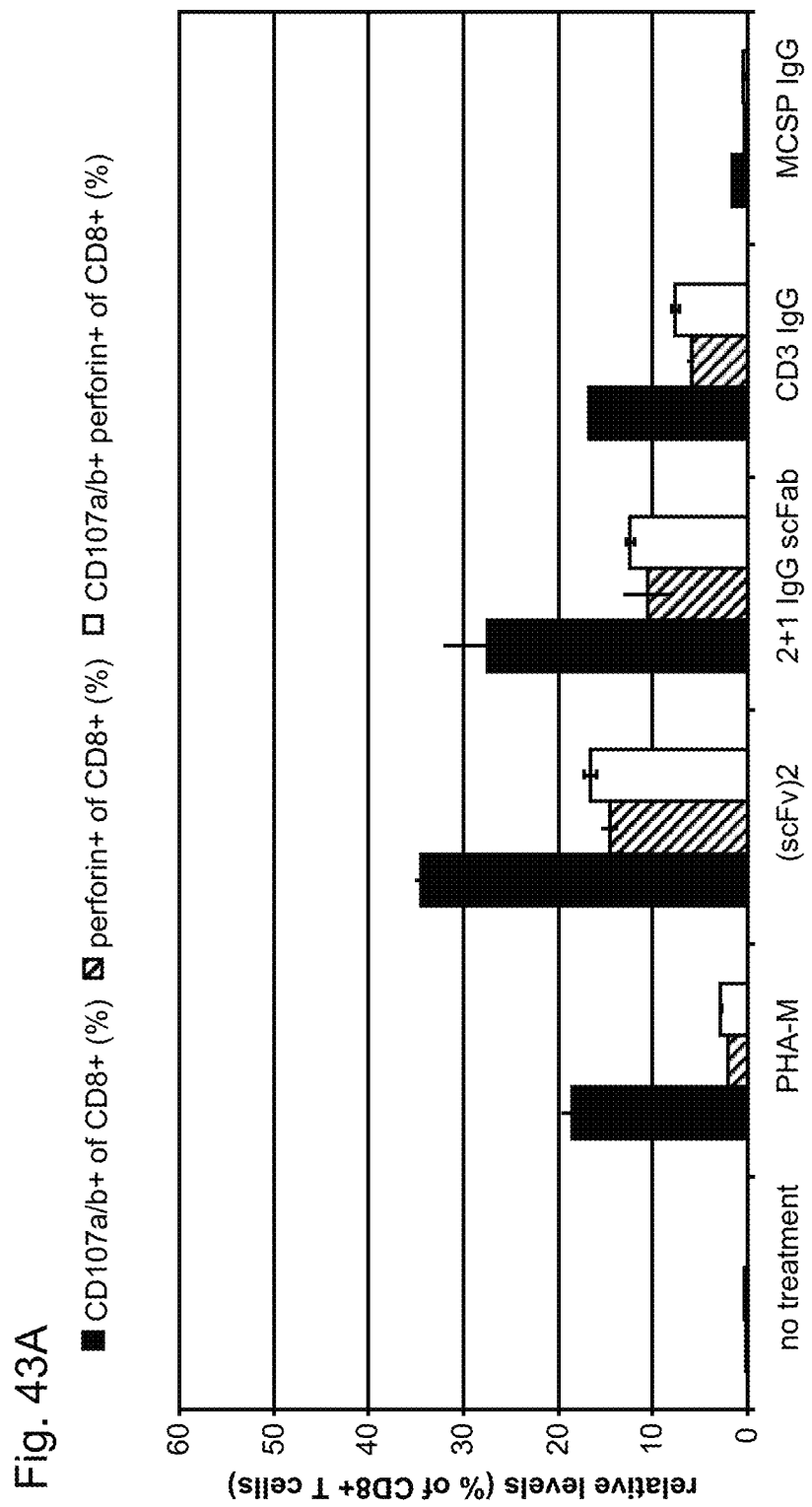

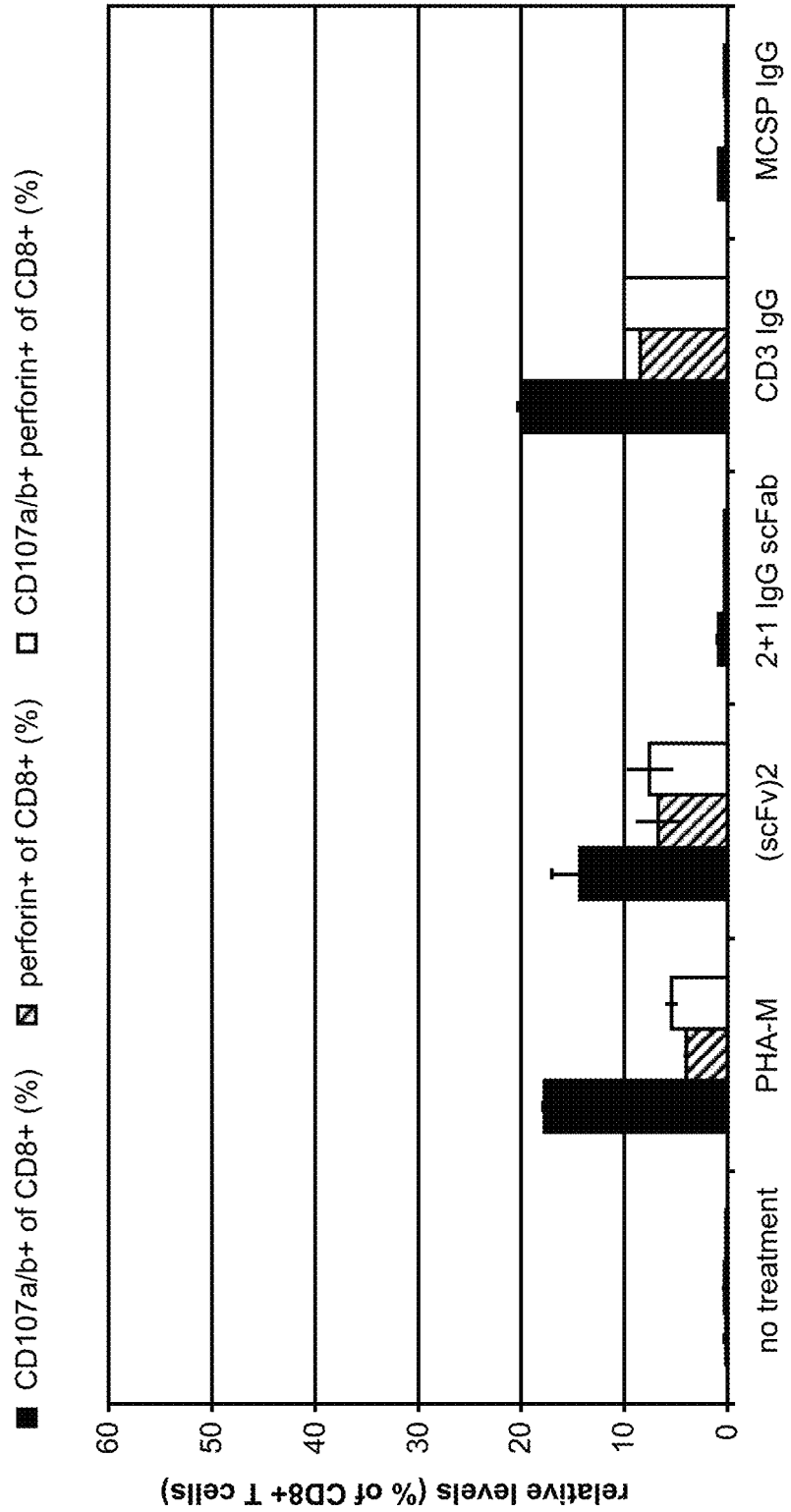

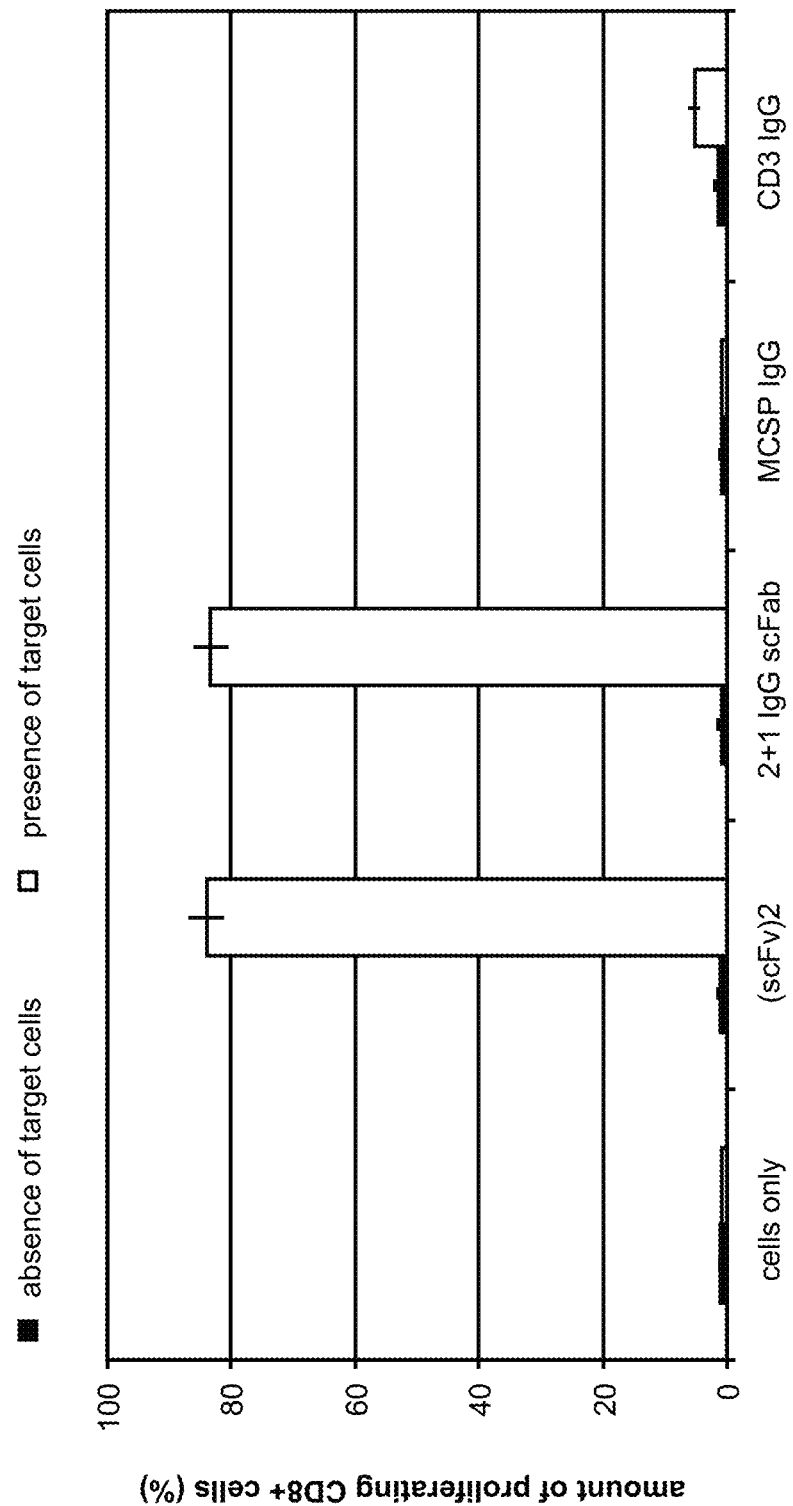

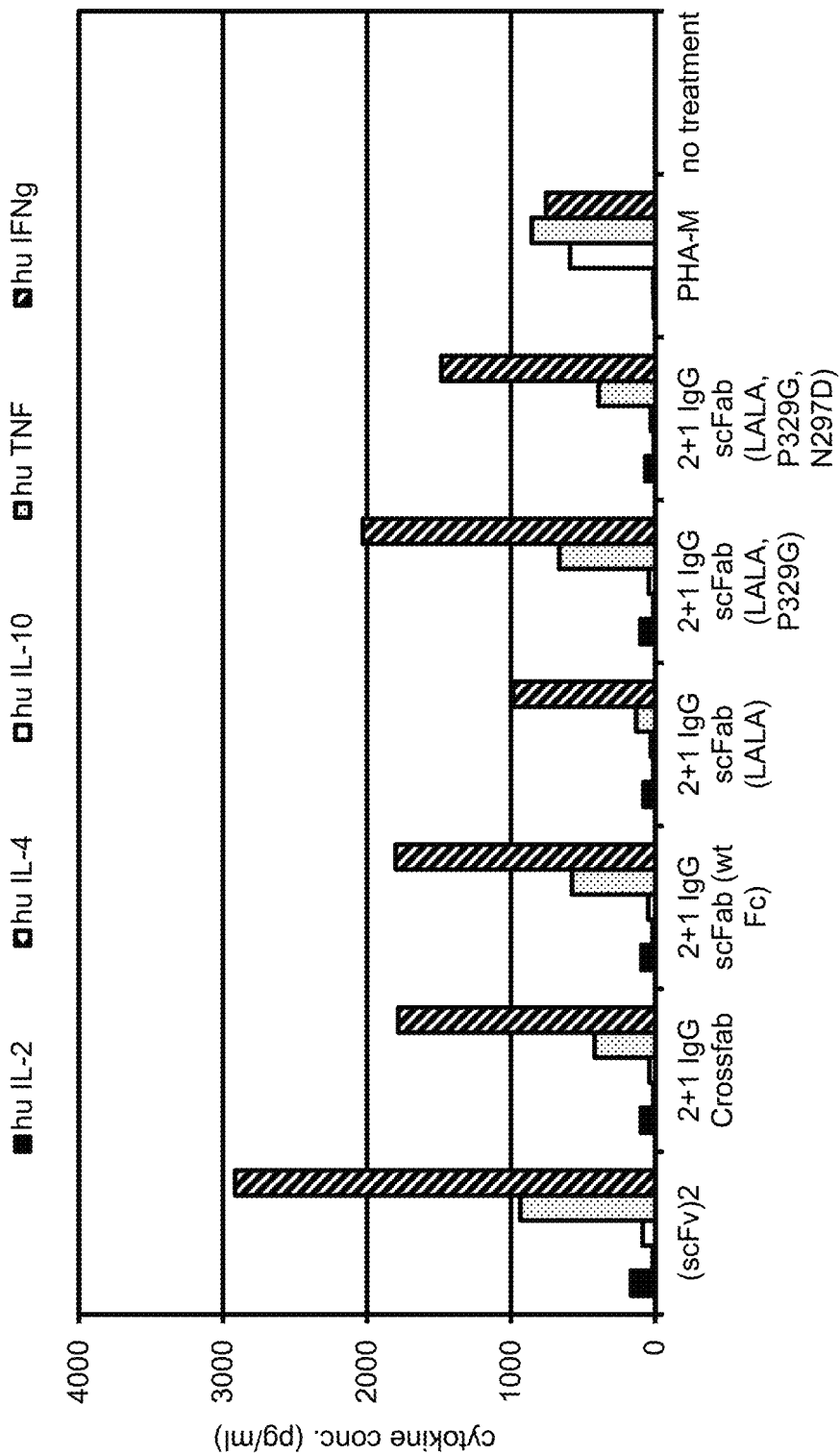

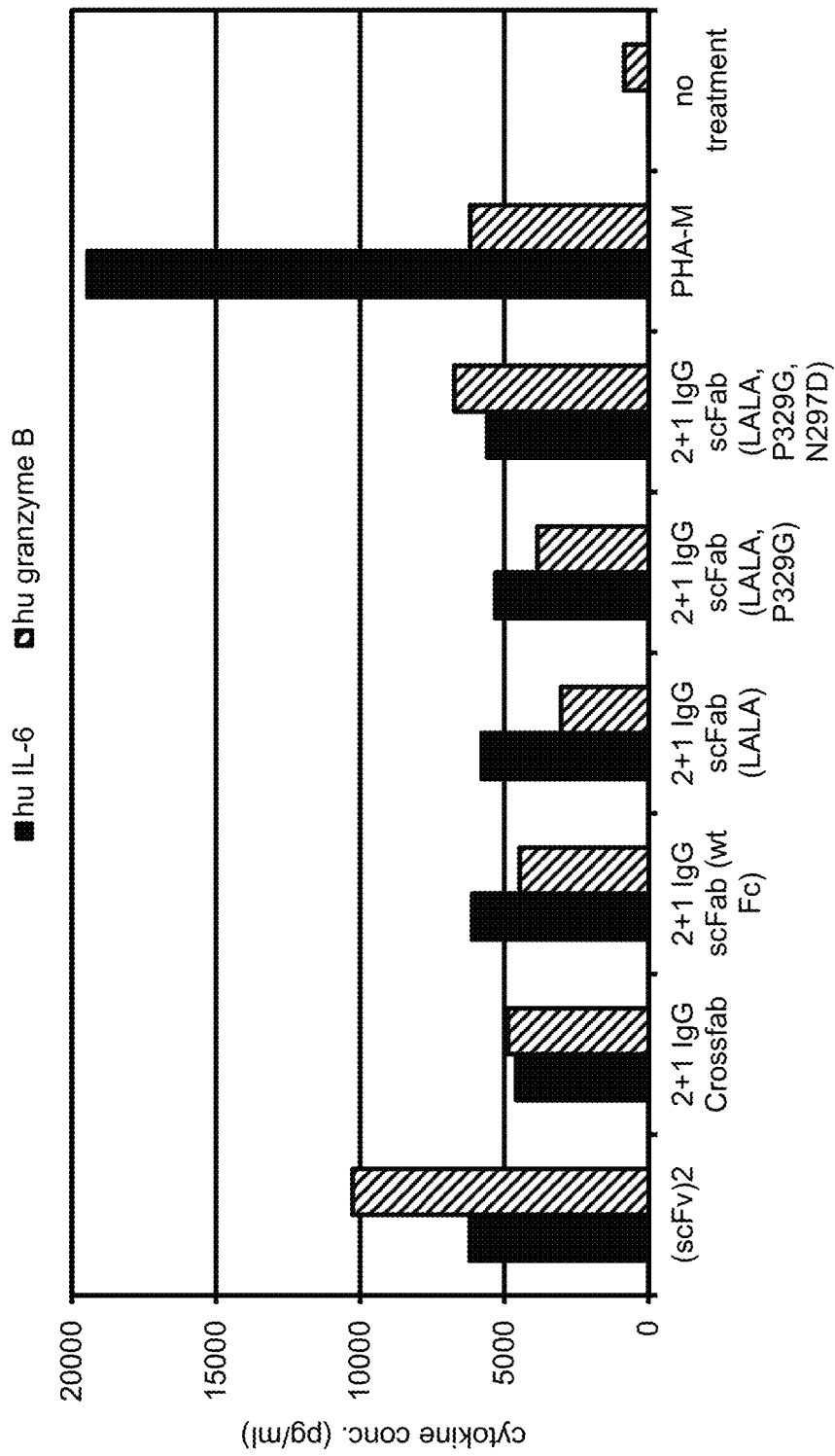

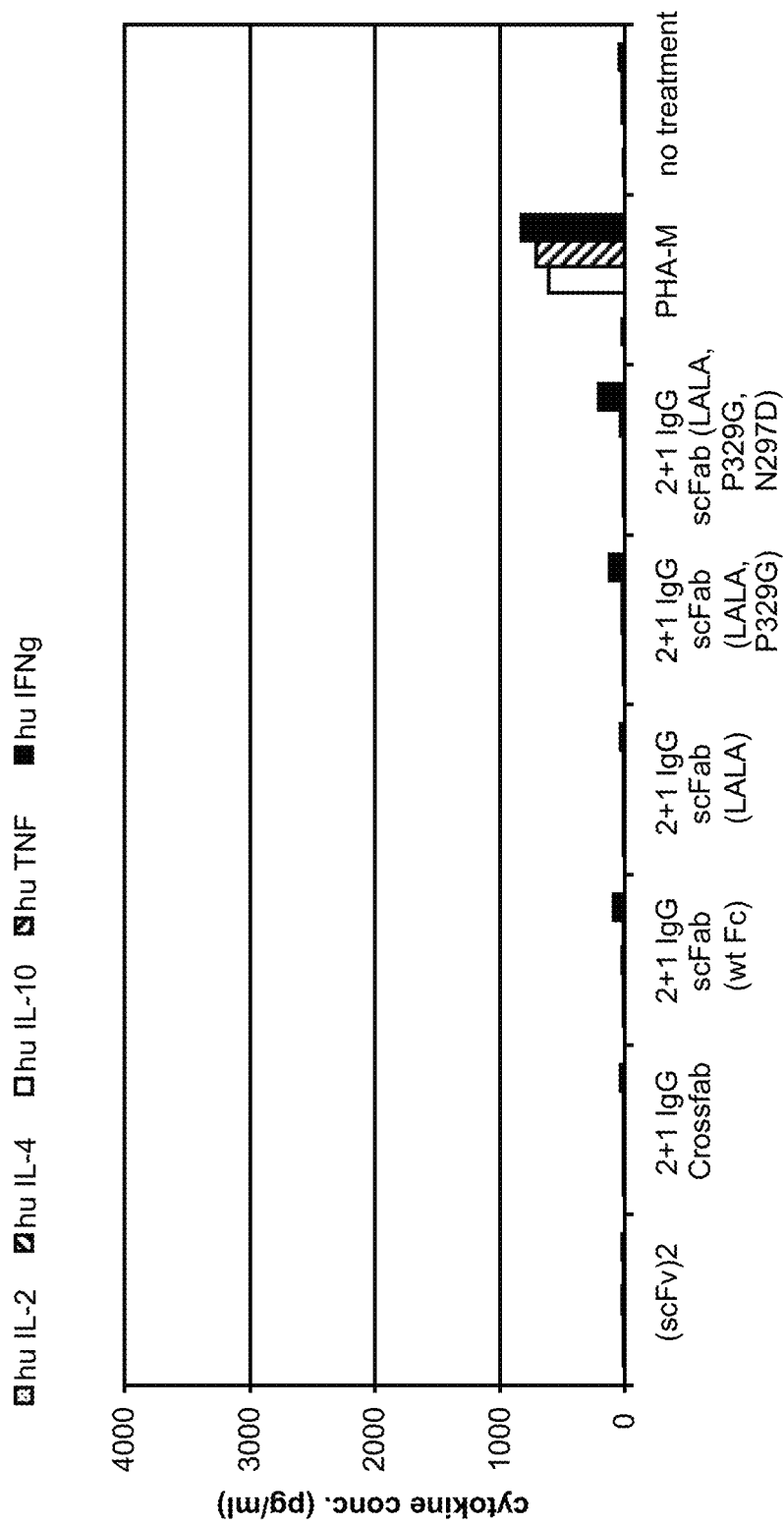

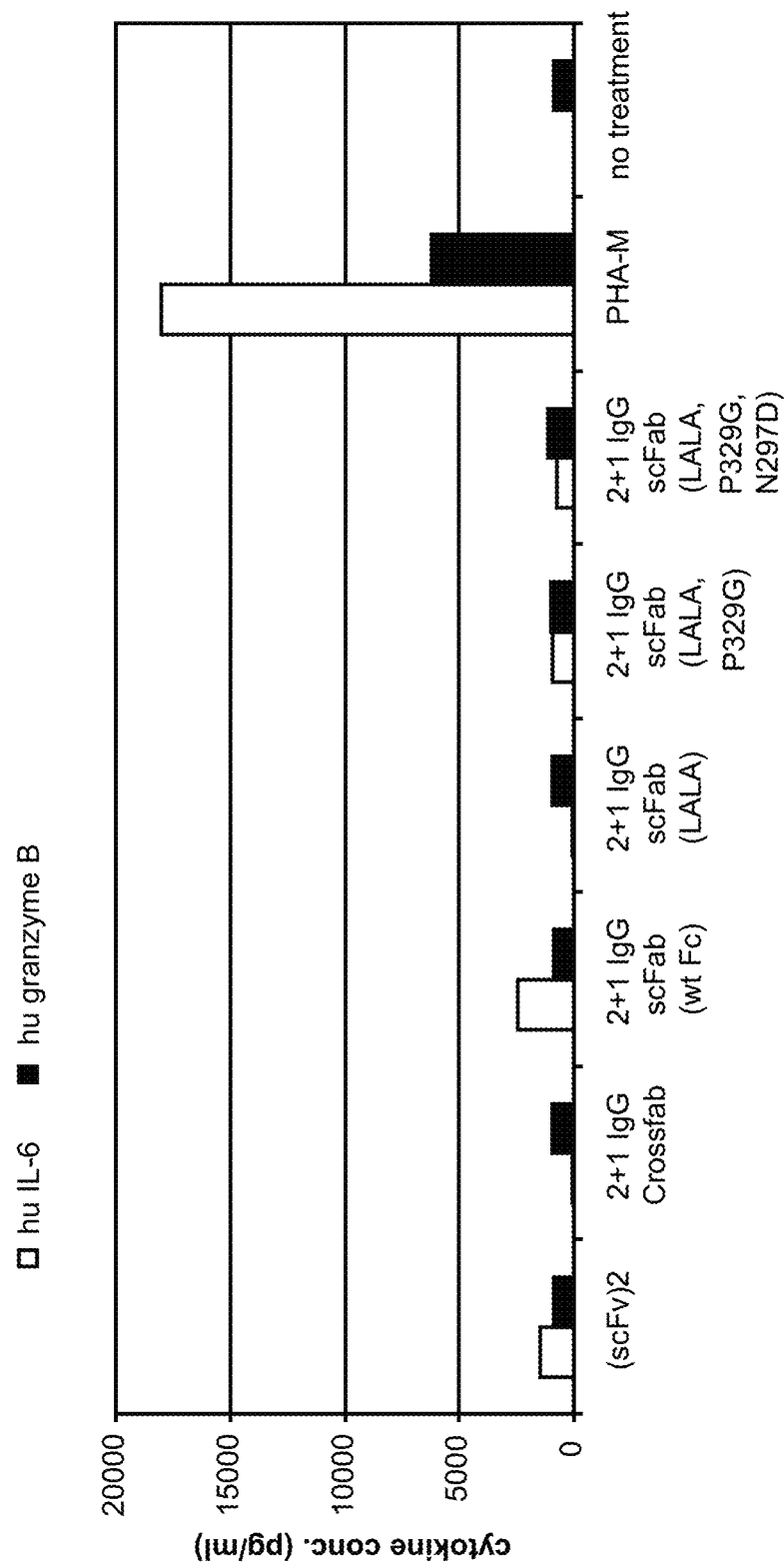

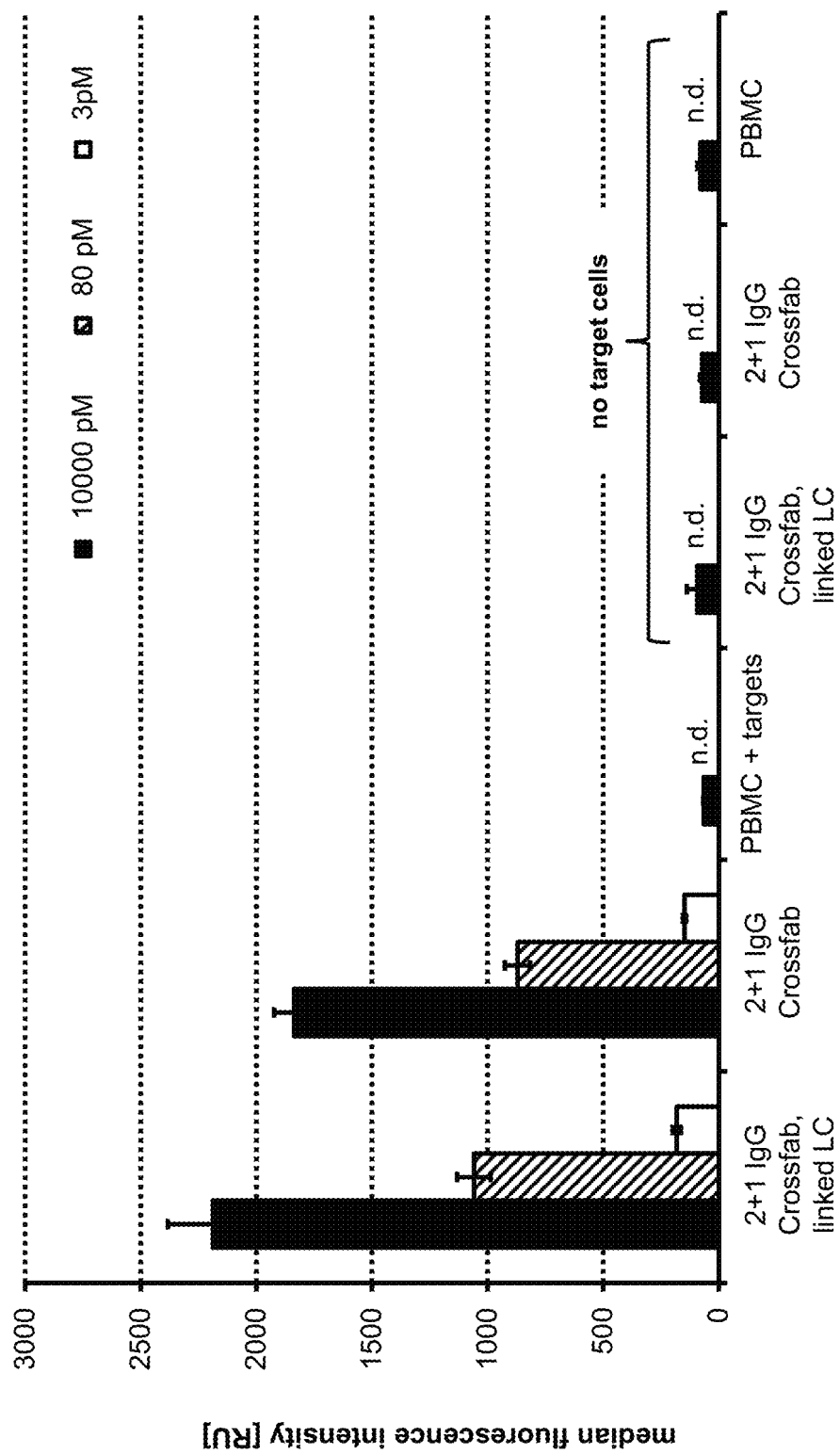

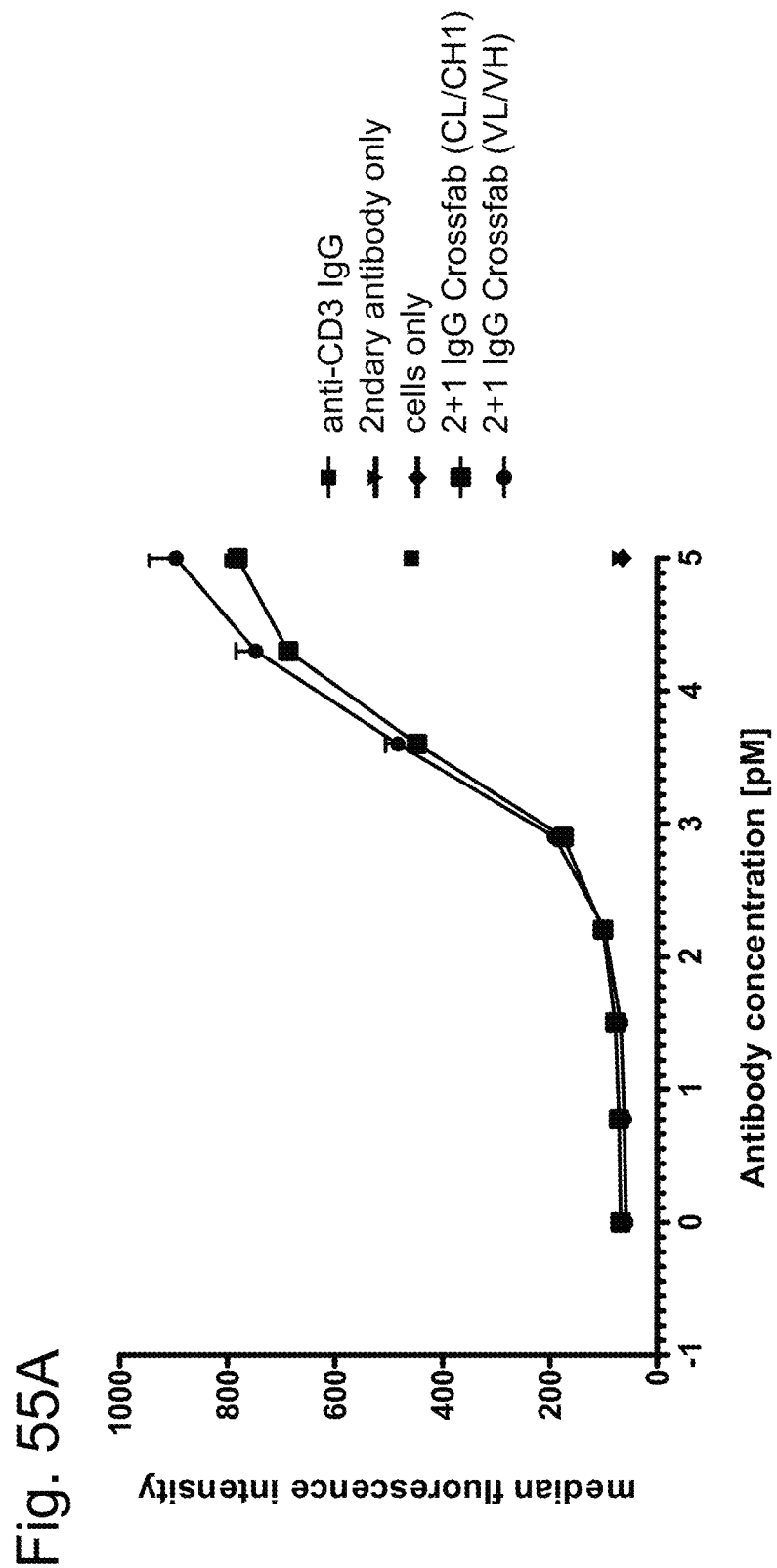

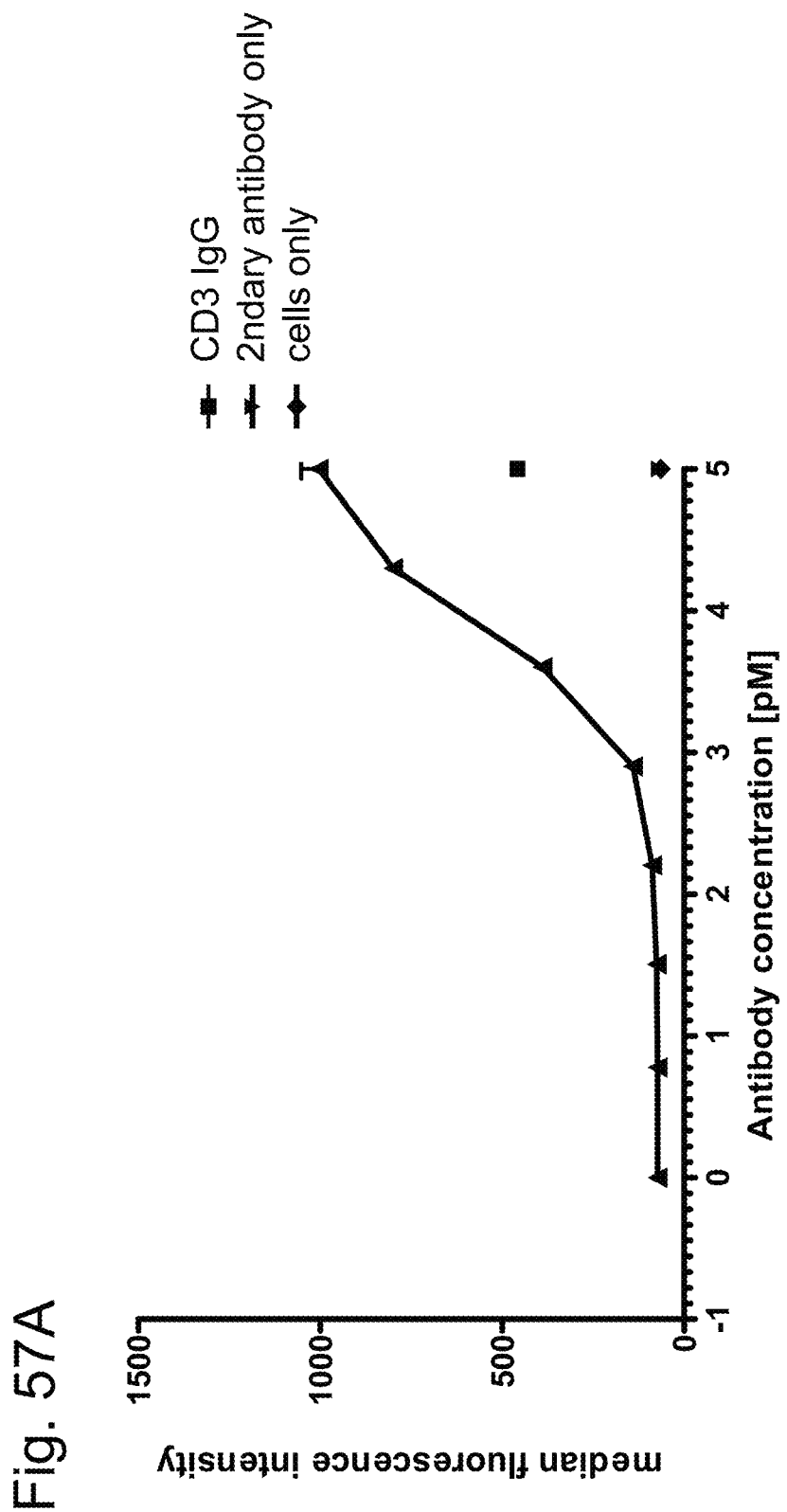

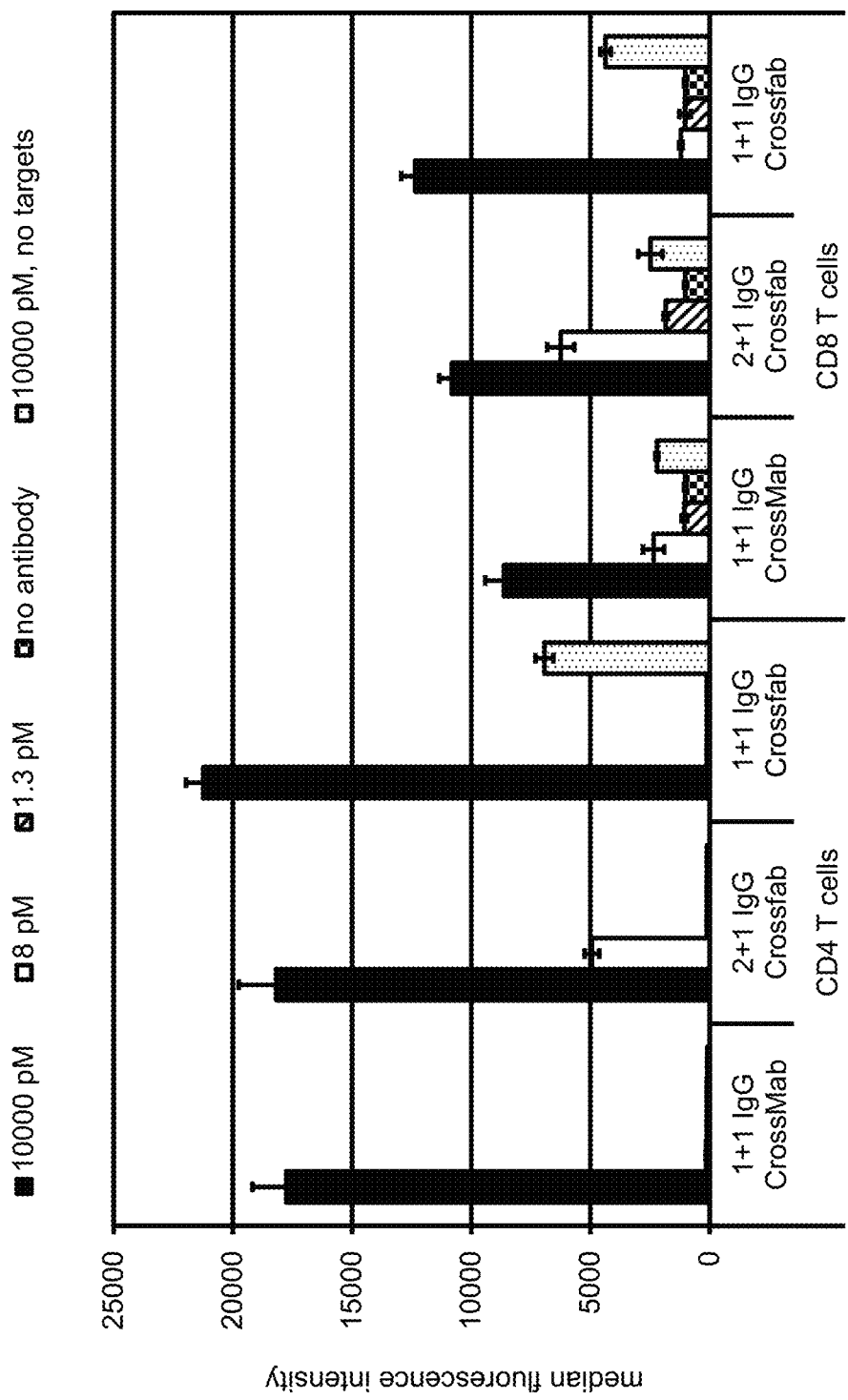

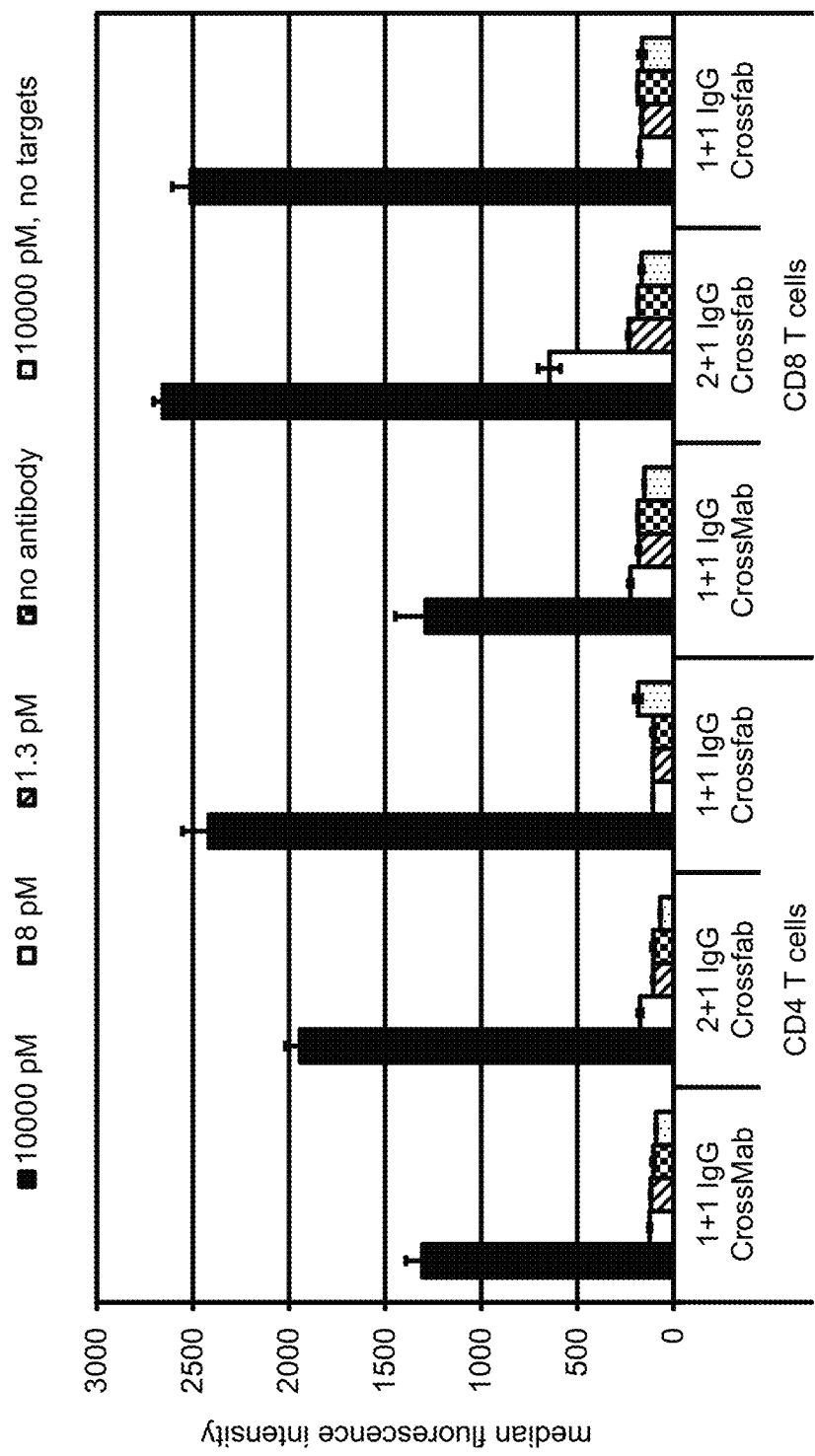

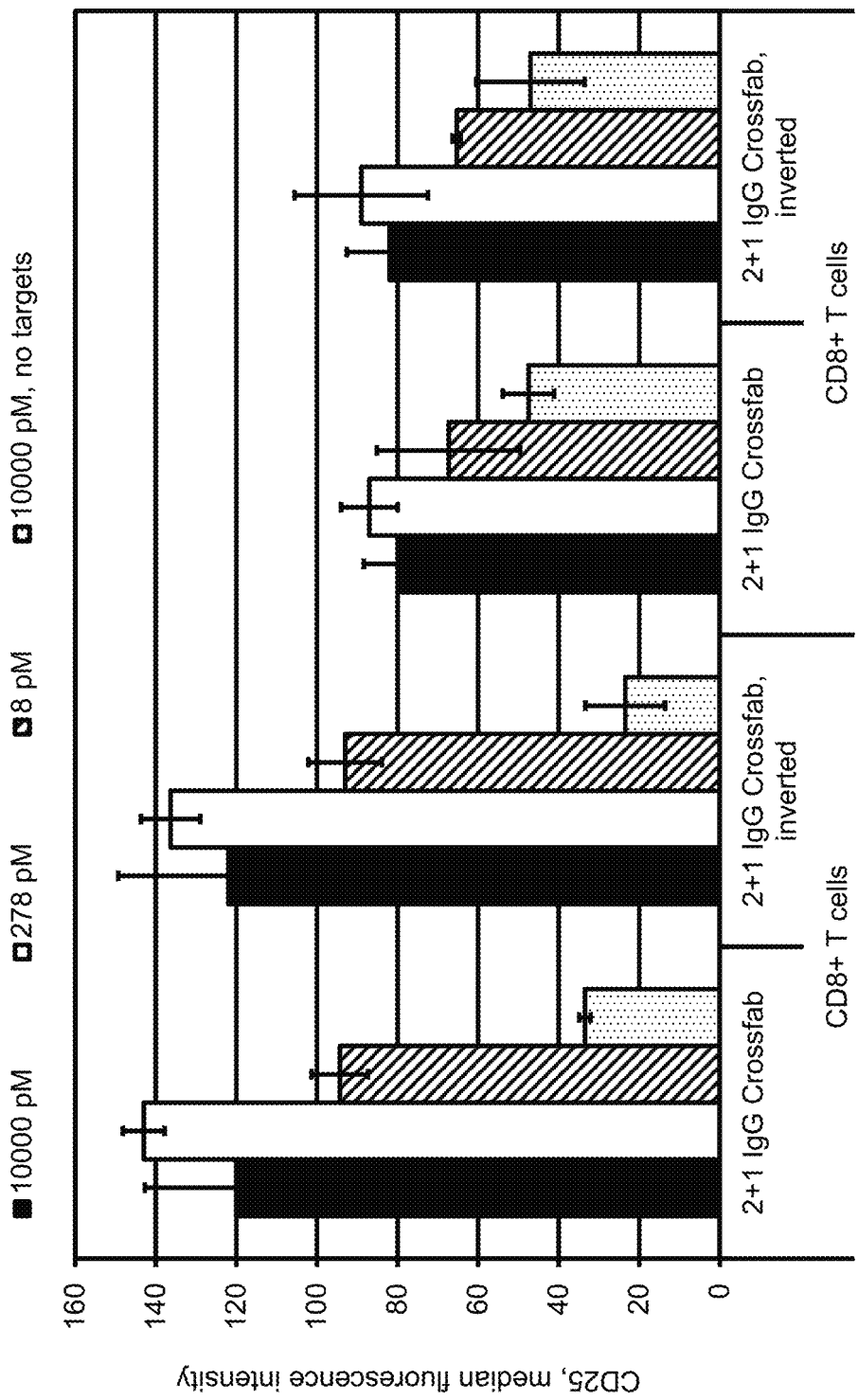

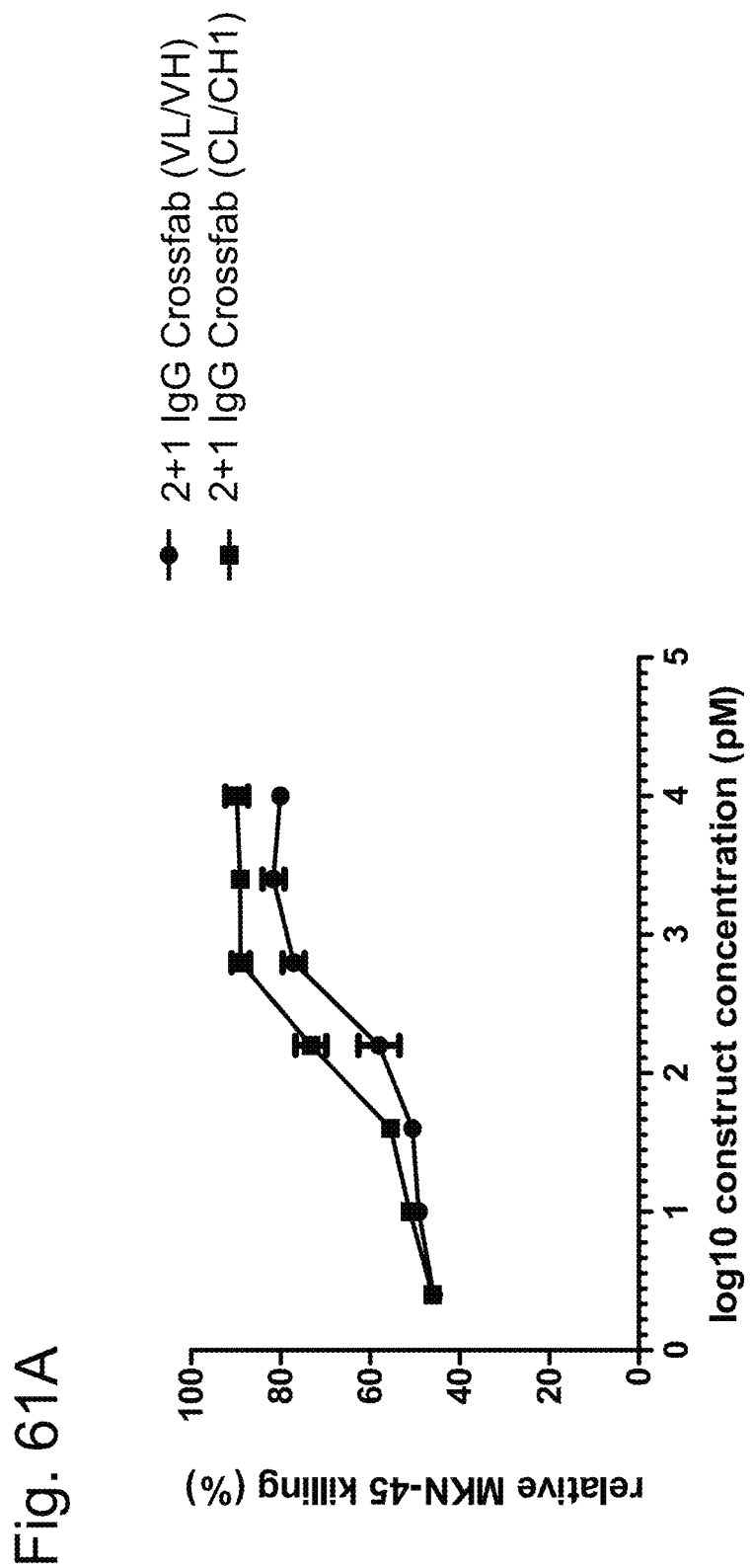

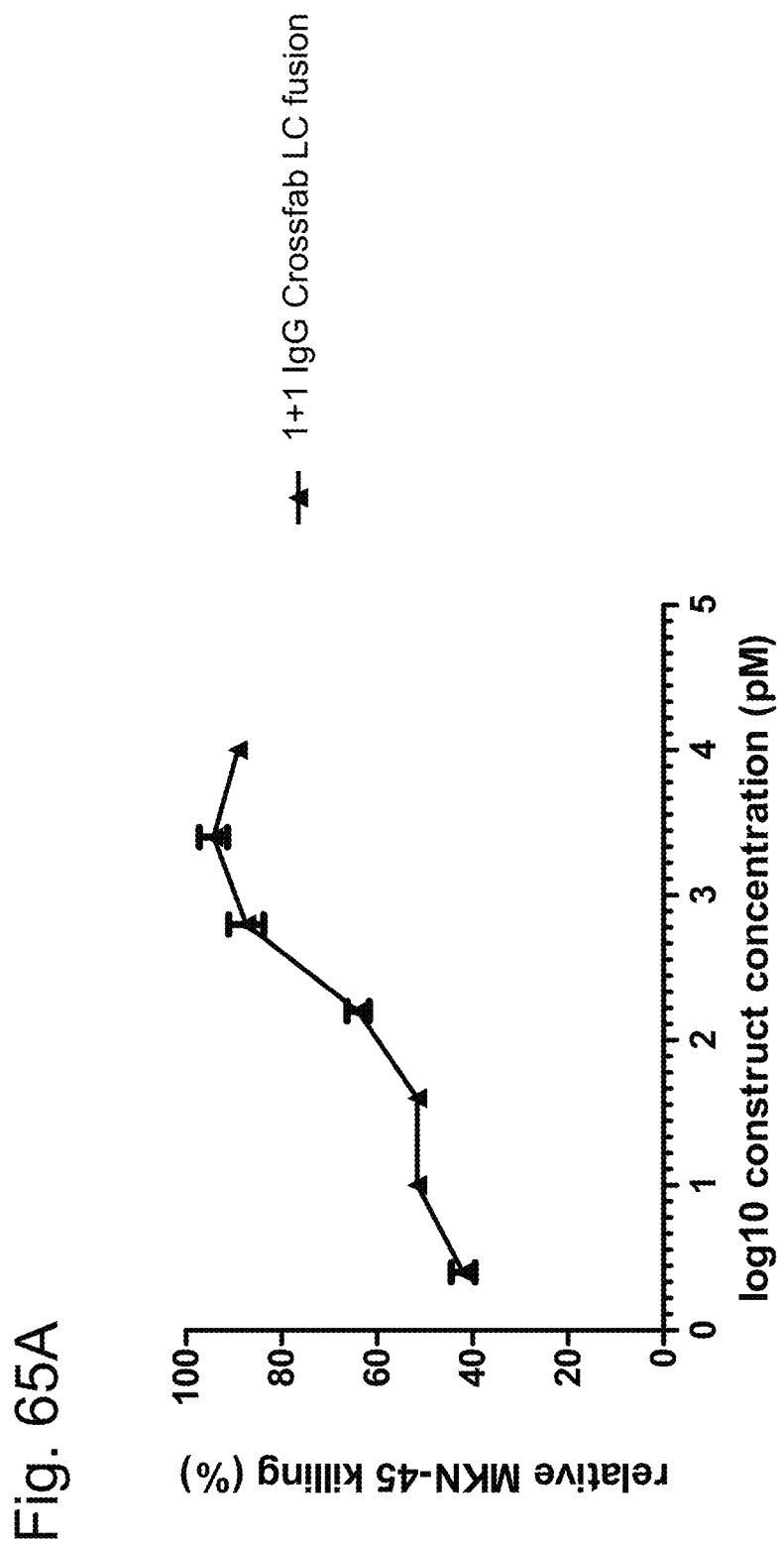

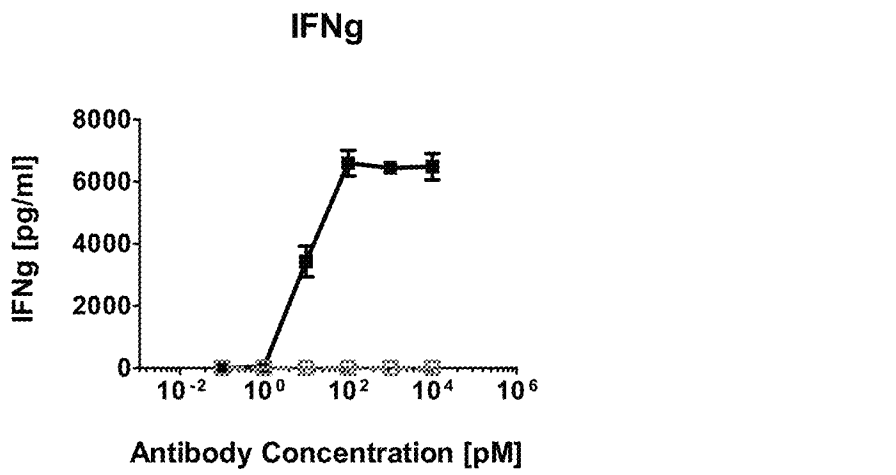
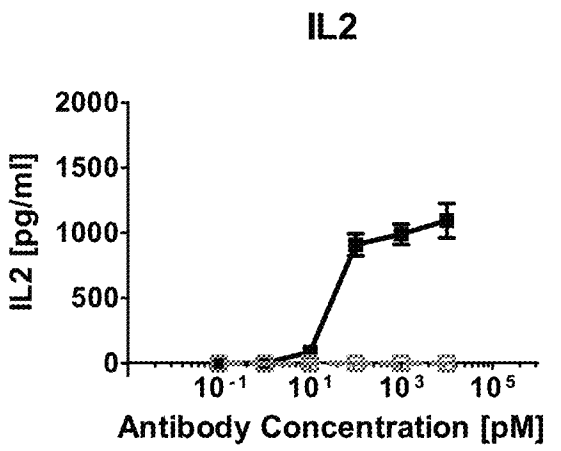
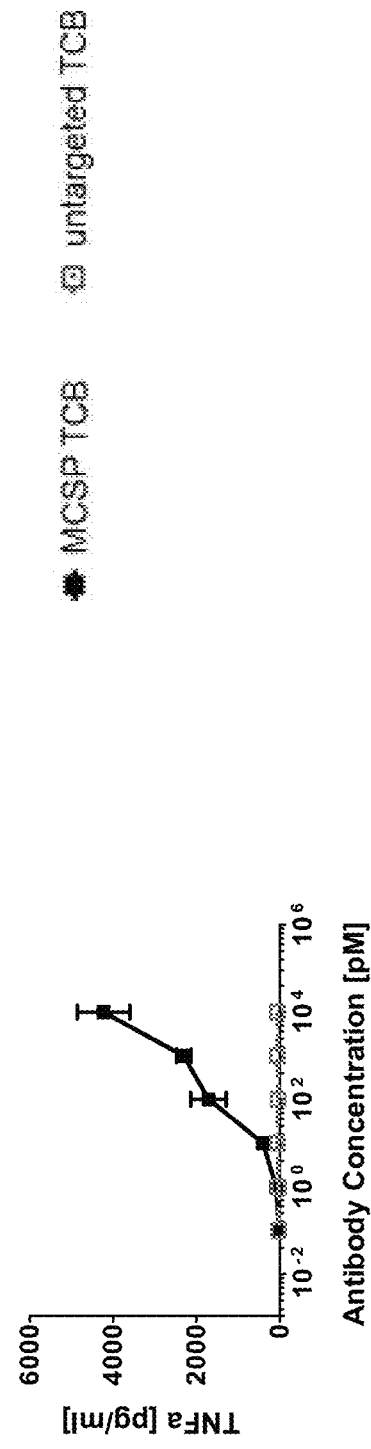

Fig. 79A
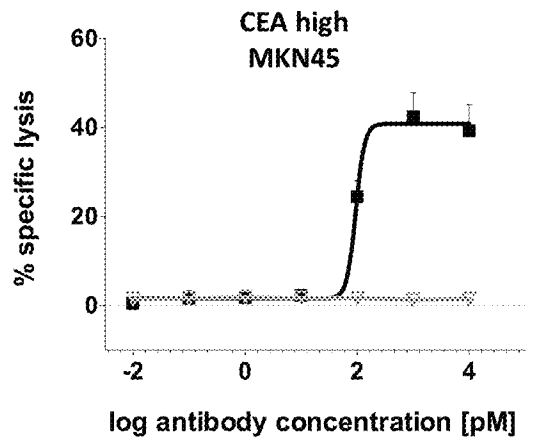
Fig. 79B
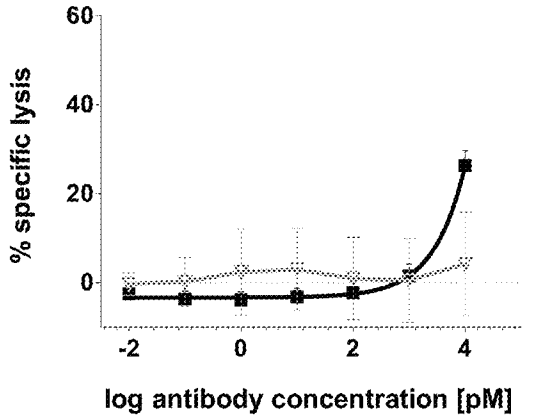
Fig. 79C

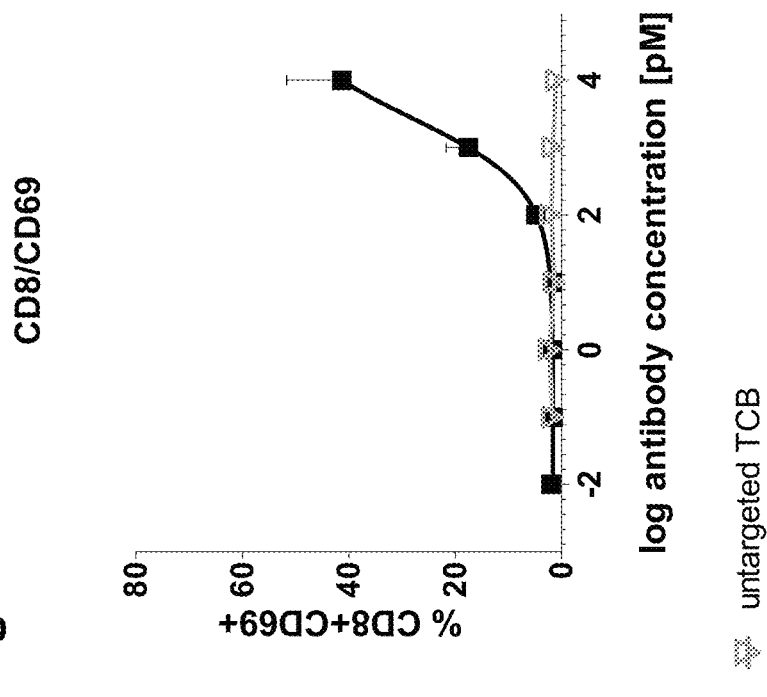

Fig. 84

```
parental HC      1 QVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADPDYWGQGTLVTVSS
D6 (SEQ ID NO 34) 1 ............................................................F.K.........................................
A7 (SEQ ID NO 36) 1 ...................D........................................F.R.........................................
B7 (SEQ ID NO 39) 1 ............................................................F.I.........................................
B8 (SEQ ID NO 41) 1 ............................................................F.R.........................................
C1 (SEQ ID NO 13) 1 ............................................................F...........................................

parental LC      1 DIQMTQSPSSLSASVGDRVTITCRASQGIRNYLNWYQQKPGKAPKLLIYYTSSLHSGVPSRFSGSGSGTDFTLTISSLQPEDFATYYCQQYSKLPWTFGQGTKVEIK
G3 (SEQ ID NO 17)   1 ...............................................................Y........................A..............
E10(SEQ ID NO 43)   1 ......................Y...G.................................................H.........................
E10-G3 (SEQ ID NO 46) 1 ......................Y...G......................................................H.........A............
C5 (SEQ ID NO 47)   1 ......................R...E.................................................G..................E......
C5-G3 (SEQ ID NO 51) 1 ......................R...E.................................................G..................A......
```

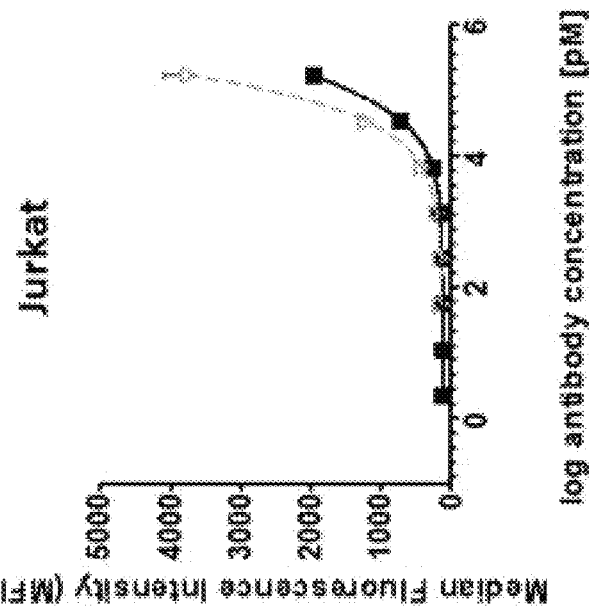
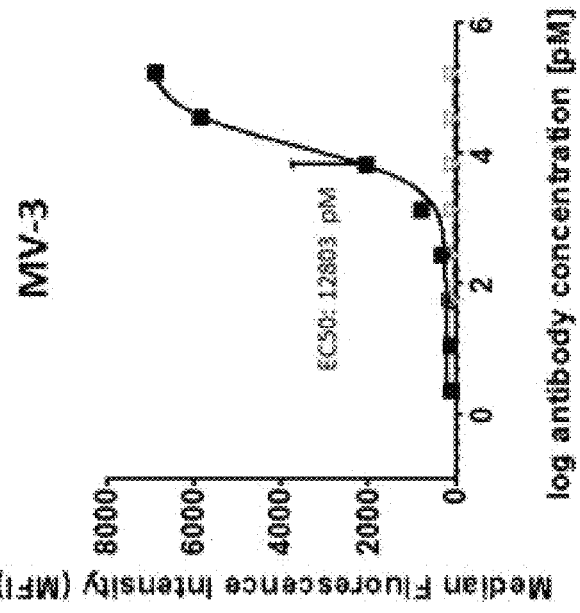
Fig. 95A
Fig. 95B

BISPECIFIC T CELL ACTIVATING ANTIGEN BINDING MOLECULES

CROSS REFERENCE TO RELATED APPLICATIONS

This application is a continuation of U.S. application Ser. No. 14/835,439, filed on Aug. 25, 2015, which is a continuation of International Application No. PCT/EP2014/053378 having an international filing date of Feb. 21, 2014, the entire contents of which are incorporated herein by reference, and which claims benefit under 35 U.S.C. § 119 to European Patent Application No. 13156674.7, filed on Feb. 26, 2013.

SEQUENCE LISTING

The instant application contains a Sequence Listing which has been submitted electronically in ASCII format and is hereby incorporated by reference in its entirety. Said ASCII copy, created on Jan. 10, 2020, is named 51177-020002_Sequence_Listing_1.10.20_ST25 and is 632,849 bytes in size. No new matter has been added.

FIELD OF THE INVENTION

The present invention generally relates to bispecific antigen binding molecules for activating T cells. In addition, the present invention relates to polynucleotides encoding such bispecific antigen binding molecules, and vectors and host cells comprising such polynucleotides. The invention further relates to methods for producing the bispecific antigen binding molecules of the invention, and to methods of using these bispecific antigen binding molecules in the treatment of disease.

BACKGROUND

The selective destruction of an individual cell or a specific cell type is often desirable in a variety of clinical settings. For example, it is a primary goal of cancer therapy to specifically destroy tumor cells, while leaving healthy cells and tissues intact and undamaged.

An attractive way of achieving this is by inducing an immune response against the tumor, to make immune effector cells such as natural killer (NK) cells or cytotoxic T lymphocytes (CTLs) attack and destroy tumor cells. CTLs constitute the most potent effector cells of the immune system, however they cannot be activated by the effector mechanism mediated by the Fc domain of conventional therapeutic antibodies.

In this regard, bispecific antibodies designed to bind with one "arm" to a surface antigen on target cells, and with the second "arm" to an activating, invariant component of the T cell receptor (TCR) complex, have become of interest in recent years. The simultaneous binding of such an antibody to both of its targets will force a temporary interaction between target cell and T cell, causing activation of any cytotoxic T cell and subsequent lysis of the target cell. Hence, the immune response is re-directed to the target cells and is independent of peptide antigen presentation by the target cell or the specificity of the T cell as would be relevant for normal MHC-restricted activation of CTLs. In this context it is crucial that CTLs are only activated when a target cell is presenting the bispecific antibody to them, i.e. the immunological synapse is mimicked. Particularly desirable are bispecific antibodies that do not require lymphocyte preconditioning or co-stimulation in order to elicit efficient lysis of target cells.

Several bispecific antibody formats have been developed and their suitability for T cell mediated immunotherapy investigated. Out of these, the so-called BiTE (bispecific T cell engager) molecules have been very well characterized and already shown some promise in the clinic (reviewed in Nagorsen and Bäuerle, Exp Cell Res 317, 1255-1260 (2011)). BiTEs are tandem scFv molecules wherein two scFv molecules are fused by a flexible linker. Further bispecific formats being evaluated for T cell engagement include diabodies (Holliger et al., Prot Eng 9, 299-305 (1996)) and derivatives thereof, such as tandem diabodies (Kipriyanov et al., J Mol Biol 293, 41-66 (1999)). A more recent development are the so-called DART (dual affinity retargeting) molecules, which are based on the diabody format but feature a C-terminal disulfide bridge for additional stabilization (Moore et al., Blood 117, 4542-51 (2011)). The so-called triomabs, which are whole hybrid mouse/rat IgG molecules and also currently being evaluated in clinical trials, represent a larger sized format (reviewed in Seimetz et al., Cancer Treat Rev 36, 458-467 (2010)).

The variety of formats that are being developed shows the great potential attributed to T cell re-direction and activation in immunotherapy. The task of generating bispecific antibodies suitable therefor is, however, by no means trivial, but involves a number of challenges that have to be met related to efficacy, toxicity, applicability and producibility of the antibodies.

Small constructs such as, for example, BiTE molecules—while being able to efficiently crosslink effector and target cells—have a very short serum half life requiring them to be administered to patients by continuous infusion. IgG-like formats on the other hand—while having the great benefit of a long half life—suffer from toxicity associated with the native effector functions inherent to IgG molecules. Their immunogenic potential constitutes another unfavorable feature of IgG-like bispecific antibodies, especially non-human formats, for successful therapeutic development. Finally, a major challenge in the general development of bispecific antibodies has been the production of bispecific antibody constructs at a clinically sufficient quantity and purity, due to the mispairing of antibody heavy and light chains of different specificities upon co-expression, which decreases the yield of the correctly assembled construct and results in a number of non-functional side products from which the desired bispecific antibody may be difficult to separate.

Given the difficulties and disadvantages associated with currently available bispecific antibodies for T cell mediated immunotherapy, there remains a need for novel, improved formats of such molecules. The present invention provides bispecific antigen binding molecules designed for T cell activation and re-direction that combine good efficacy and producibility with low toxicity and favorable pharmacokinetic properties. In particular there are provided novel bispecific antigen binding molecules comprising binding proteins with at least one ankyrin repeat motiv. There are also provided novel bispecific antigen binding molecules comprising a single domain variable heavy chain. These novel molecules have the advantage that they can be produced with less side-products as there is no mispairing between the binder comprising the ankyrin motiv or the single domain variable heavy chain, respectively and the binder comprising antibody heavy and light chains.

There are also provided novel bispecific antigen binding molecules comprising a modification promoting association of the first and the second subunit of the Fc domain via electrostatic steering effects. Thereby correct chain association of the Fc domain is promoted and less undesired by-products occur during production of these molecules.

SUMMARY OF THE INVENTION

In one aspect the present invention provides a T cell activating bispecific antigen binding molecule comprising a first antigen binding moiety capable of specific binding to an activating T cell antigen, and a second antigen binding moiety capable of specific binding to a target cell antigen, wherein said one antigen binding moiety is a Fab molecule or a crossover Fab molecule wherein either the variable or the constant regions of the Fab light chain and the Fab heavy chain are exchanged and wherein the other antigen binding moiety comprises a single domain antigen binding molecule.

In one embodiment said a single domain antigen binding molecule is a single domain variable heavy chain.

In one embodiment the T cell activating bispecific antigen binding molecule comprises a first antigen binding moiety capable of specific binding to an activating T cell antigen, wherein said first antigen binding moiety comprises a crossover Fab molecule wherein either the variable or the constant regions of the Fab light chain and the Fab heavy chain are exchanged and a second antigen binding moiety capable of specific binding to a target cell antigen wherein said second antigen binding moiety consists of a single domain variable heavy chain.

In one aspect the present invention provides a T cell activating bispecific antigen binding molecule comprising a first antigen binding moiety capable of specific binding to an activating T cell antigen, and a second antigen binding moiety capable of specific binding to a target cell antigen, wherein said one antigen binding moiety is a Fab molecule or a crossover Fab molecule wherein either the variable or the constant regions of the Fab light chain and the Fab heavy chain are exchanged and wherein the other antigen binding moiety is a binding protein comprising at least one ankyrin repeat motiv.

In one such embodiment said first antigen binding moiety capable of specific binding to an activating T cell antigen is a crossover Fab molecule wherein either the variable or the constant regions of the Fab light chain and the Fab heavy chain are exchanged and wherein the second antigen binding moiety is a binding protein comprising at least one ankyrin repeat motiv.

In one such embodiment said second antigen moiety comprises a binding protein comprising two, three, four our five ankyrin repeat motifs.

In one embodiment said T cell activating bispecific antigen binding molecule additionally comprises an Fc domain composed of a first and a second subunit capable of stable association.

In a particular embodiment, not more than one antigen binding moiety capable of specific binding to an activating T cell antigen is present in the T cell activating bispecific antigen binding molecule (i.e. the T cell activating bispecific antigen binding molecule provides monovalent binding to the activating T cell antigen). In particular embodiments, the first antigen binding moiety is a crossover Fab molecule.

In one embodiment the first and the second antigen binding moiety are fused to each other, optionally via a peptide linker.

In one embodiment the second antigen binding moiety is fused at the C-terminus of the Fab heavy chain to the N-terminus of the Fab heavy chain of the first antigen binding moiety.

In one embodiment said T cell activating bispecific antigen binding molecule additionally comprises a third antigen binding moiety capable of specific binding to a target cell antigen.

In one such embodiment the third antigen binding moiety capable of specific binding to a target cell antigen is a single domain variable heavy chain.

In one embodiment the T cell activating bispecific antigen binding molecule comprises a) an Fc domain composed of a first and a second subunit capable of stable association, b) a first antigen binding moiety comprising a crossover Fab molecule wherein either the variable or the constant regions of the Fab light chain and the Fab heavy chain are exchanged, wherein said crossover Fab molecule is fused at the C-terminus of the Fab heavy chain to the N-terminus of one of the subunits of the Fc domain;

c) a second antigen binding moiety comprising a single domain variable heavy chain, wherein said single domain variable heavy chain is fused to the N-terminus of one of the subunits of the Fc domain, and d) a third antigen binding moiety comprising a single domain variable heavy chain wherein said single domain variable heavy chain is fused to the N-terminus of the Fab heavy chain of the first antigen binding moiety.

In one such embodiment the third antigen binding moiety capable of specific binding to a target cell antigen is a binding protein comprising at least one ankyrin repeat motiv.

In one such embodiment the third antigen binding moiety capable of specific binding to a target cell antigen is a binding protein comprising two, three, four our five ankyrin repeat motifs In one embodiment the T cell activating bispecific antigen binding molecule comprises a) an Fc domain composed of a first and a second subunit capable of stable association, b) a first antigen binding moiety comprising a crossover Fab molecule wherein either the variable or the constant regions of the Fab light chain and the Fab heavy chain are exchanged, wherein said crossover Fab molecule is fused at the C-terminus of the Fab heavy chain to the N-terminus of one of the subunits of the Fc domain;

c) a second antigen binding moiety comprising a binding protein comprising at least one ankyrin repeat motiv, wherein said binding protein comprising at least one ankyrin repeat motiv is fused to the N-terminus of one of the subunits of the Fc domain, and d) a third antigen binding moiety comprising binding protein comprising at least one ankyrin repeat motiv wherein binding protein comprising at least one ankyrin repeat motiv is fused to the N-terminus of the Fab heavy chain of the first antigen binding moiety.

In one embodiment said first antigen binding moiety binds to an activating T cell antigen and said second and third antigen binding moiety bind to the same target cell antigen.

In a particular embodiment, the Fc domain is an IgG Fc domain. In a specific embodiment, the Fc domain is an $IgG_1$ Fc domain. In another specific embodiment, the Fc domain is an $IgG_4$ Fc domain. In particular embodiments the Fc domain is a human Fc domain.

In particular embodiments the Fc domain comprises a modification promoting the association of the first and the second Fc domain subunit. In a specific such embodiment, an amino acid residue in the CH3 domain of the first subunit of the Fc domain is replaced with an amino acid residue having a larger side chain volume, thereby generating a protuberance within the CH3 domain of the first subunit which is positionable in a cavity within the CH3 domain of the second subunit, and an amino acid residue in the CH3 domain of the second subunit of the Fc domain is replaced with an amino acid residue having a smaller side chain volume, thereby generating a cavity within the CH3 domain of the second subunit within which the protuberance within the CH3 domain of the first subunit is positionable.

In a particular embodiment the Fc domain exhibits reduced binding affinity to an Fc receptor and/or reduced effector function, as compared to a native $IgG_1$ Fc domain. In certain embodiments the Fc domain is engineered to have reduced binding affinity to an Fc receptor and/or reduced effector function, as compared to a non-engineered Fc domain. In one embodiment, the Fc domain comprises one or more amino acid substitution that reduces binding to an Fc receptor and/or effector function. In one embodiment, the one or more amino acid substitution in the Fc domain that reduces binding to an Fc receptor and/or effector function is at one or more position selected from the group of L234, L235, and P329. In particular embodiments, each subunit of the Fc domain comprises three amino acid substitutions that reduce binding to an Fc receptor and/or effector function wherein said amino acid substitutions are L234A, L235A and P329G. In one such embodiment, the Fc domain is an $IgG_1$ Fc domain, particularly a human $IgG_1$ Fc domain. In other embodiments, each subunit of the Fc domain comprises two amino acid substitutions that reduce binding to an Fc receptor and/or effector function wherein said amino acid substitutions are L235E and P329G. In one such embodiment, the Fc domain is an $IgG_4$ Fc domain, particularly a human $IgG_4$ Fc domain. In one such embodiment, the Fc domain is an $IgG_4$ Fc domain, particularly a human $IgG_4$ Fc domain and comprises the amino acid substitutions L235E and S228P (SPLE).

In one embodiment the Fc receptor is an Fcγ receptor. In one embodiment the Fc receptor is a human Fc receptor. In one embodiment, the Fc receptor is an activating Fc receptor. In a specific embodiment, the Fc receptor is human FcγRIIa, FcγRI, and/or FcγRIIIa. In one embodiment, the effector function is antibody-dependent cell-mediated cytotoxicity (ADCC).

In one aspect the present invention provides a T cell activating bispecific antigen binding molecule comprising a first and a second antigen binding moiety, one of which is a Fab molecule capable of specific binding to an activating T cell antigen and the other one of which is a Fab molecule capable of specific binding to a target cell antigen; wherein the first antigen binding moiety is (a) a single chain Fab molecule wherein the Fab light chain and the Fab heavy chain are connected by a peptide linker, or (b) a crossover Fab molecule wherein either the variable or the constant regions of the Fab light chain and the Fab heavy chain are exchanged; and an Fc domain composed of a first and a second subunit capable of stable association, wherein said first subunit and said second subunit have been modified to comprise one or more charged amino acids electrostatically favorable to heterodimer formation.

In one embodiment, said first subunit comprises amino acid mutations E356K, E357K and D399K and said second subunit comprises amino acid mutations K370E, K409E and K439E, In one embodiment, said first subunit comprises amino acid mutations K392D, K409D and said second subunit comprises amino acid mutations E356K, D399K (DDKK).

In a particular embodiment, not more than one antigen binding moiety capable of specific binding to an activating T cell antigen is present in the T cell activating bispecific antigen binding molecule (i.e. the T cell activating bispecific antigen binding molecule provides monovalent binding to the activating T cell antigen). In particular embodiments, the first antigen binding moiety is a crossover Fab molecule. In even more particular embodiments, the first antigen binding moiety is a crossover Fab molecule wherein the constant regions of the Fab light chain and the Fab heavy chain are exchanged.

In some embodiments, the first and the second antigen binding moiety of the T cell activating bispecific antigen binding molecule are fused to each other, optionally via a peptide linker. In one such embodiment, the second antigen binding moiety is fused at the C-terminus of the Fab heavy chain to the N-terminus of the Fab heavy chain of the first antigen binding moiety. In another such embodiment, the first antigen binding moiety is fused at the C-terminus of the Fab heavy chain to the N-terminus of the Fab heavy chain of the second antigen binding moiety. In yet another such embodiment, the second antigen binding moiety is fused at the C-terminus of the Fab light chain to the N-terminus of the Fab light chain of the first antigen binding moiety. In embodiments wherein the first antigen binding moiety is a crossover Fab molecule and wherein either (i) the second antigen binding moiety is fused at the C-terminus of the Fab heavy chain to the N-terminus of the Fab heavy chain of the first antigen binding moiety or (ii) the first antigen binding moiety is fused at the C-terminus of the Fab heavy chain to the N-terminus of the Fab heavy chain of the second antigen binding moiety, additionally the Fab light chain of the first antigen binding moiety and the Fab light chain of the second antigen binding moiety may be fused to each other, optionally via a peptide linker.

In one embodiment, the second antigen binding moiety of the T cell activating bispecific antigen binding molecule is fused at the C-terminus of the Fab heavy chain to the N-terminus of the first or the second subunit of the Fc domain. In another embodiment, the first antigen binding moiety is fused at the C-terminus of the Fab heavy chain to the N-terminus of the first or second subunit of the Fc domain.

In one embodiment, the first and the second antigen binding moiety of the T cell activating bispecific antigen binding molecule are each fused at the C-terminus of the Fab heavy chain to the N-terminus of one of the subunits of the Fc domain.

In certain embodiments, the T cell activating bispecific antigen binding molecule comprises a third antigen binding moiety which is a Fab molecule capable of specific binding to a target cell antigen. In one such embodiment, the third antigen binding moiety is fused at the C-terminus of the Fab heavy chain to the N-terminus of the first or second subunit of the Fc domain. In a particular embodiment, the second and the third antigen binding moiety of the T cell activating antigen binding molecule are each fused at the C-terminus of the Fab heavy chain to the N-terminus of one of the subunits of the Fc domain, and the first antigen binding moiety is fused at the C-terminus of the Fab heavy chain to the N-terminus of the Fab heavy chain of the second antigen binding moiety. In another particular embodiment, the first and the third antigen binding moiety of the T cell activating antigen binding molecule are each fused at the C-terminus of the Fab heavy chain to the N-terminus of one of the subunits of the Fc domain, and the second antigen binding moiety is fused at the C-terminus of the Fab heavy chain to the N-terminus of the Fab heavy chain of the first antigen binding moiety. The components of the T cell activating bispecific antigen binding molecule may be fused directly or through suitable peptide linkers. In one embodiment the second and the third antigen binding moiety and the Fc domain are part of an immunoglobulin molecule. In a particular embodiment the immunoglobulin molecule is an IgG class immunoglobulin. In an even more particular embodiment the immunoglobulin is an $IgG_1$ subclass immunoglobulin. In another embodiment, the immunoglobulin is an $IgG_4$ subclass immunoglobulin.

In a particular embodiment, the Fc domain is an IgG Fc domain. In a specific embodiment, the Fc domain is an $IgG_1$ Fc domain. In another specific embodiment, the Fc domain is an $IgG_4$ Fc domain. In particular embodiments the Fc domain is a human Fc domain.

In a particular embodiment the Fc domain exhibits reduced binding affinity to an Fc receptor and/or reduced effector function, as compared to a native $IgG_1$ Fc domain. In certain embodiments the Fc domain is engineered to have reduced binding affinity to an Fc receptor and/or reduced effector function, as compared to a non-engineered Fc domain. In one embodiment, the Fc domain comprises one or more amino acid substitution that reduces binding to an Fc receptor and/or effector function.

In one embodiment, the one or more amino acid substitution in the Fc domain that reduces binding to an Fc receptor and/or effector function is at one or more position selected from the group of L234, L235, and P329. In particular embodiments, each subunit of the Fc domain comprises three amino acid substitutions that reduce binding to an Fc receptor and/or effector function wherein said amino acid substitutions are L234A, L235A and P329G. In one such embodiment, the Fc domain is an $IgG_1$ Fc domain, particularly a human $IgG_1$ Fc domain. In other embodiments, each subunit of the Fc domain comprises two amino acid substitutions that reduce binding to an Fc receptor and/or effector function wherein said amino acid substitutions are L235E and P329G. In one such embodiment, the Fc domain is an $IgG_4$ Fc domain, particularly a human $IgG_4$ Fc domain. In one such embodiment, the Fc domain is an $IgG_4$ Fc domain, particularly a human $IgG_4$ Fc domain and comprises the amino acid substitutions L235E and S228P (SPLE).

In one embodiment the Fc receptor is an Fcγ receptor. In one embodiment the Fc receptor is a human Fc receptor. In one embodiment, the Fc receptor is an activating Fc receptor. In a specific embodiment, the Fc receptor is human FcγRIIa, FcγRI, and/or FcγRIIIa. In one embodiment, the effector function is antibody-dependent cell-mediated cytotoxicity (ADCC).

In a particular embodiment, the activating T cell antigen that the bispecific antigen binding molecule is capable of binding is CD3. In other embodiments, the target cell antigen that the bispecific antigen binding molecule is capable of binding is a tumor cell antigen. In one embodiment, the target cell antigen is selected from the group consisting of: Melanoma-associated Chondroitin Sulfate Proteoglycan (MCSP), Epidermal Growth Factor Receptor (EGFR), Carcinoembryonic Antigen (CEA), Fibroblast Activation Protein (FAP), CD19, CD20 and CD33.

According to another aspect of the invention there is provided an isolated polynucleotide encoding a T cell activating bispecific antigen binding molecule of the invention or a fragment thereof. The invention also encompasses polypeptides encoded by the polynucleotides of the invention. The invention further provides an expression vector comprising the isolated polynucleotide of the invention, and a host cell comprising the isolated polynucleotide or the expression vector of the invention. In some embodiments the host cell is a eukaryotic cell, particularly a mammalian cell. In another aspect is provided a method of producing the T cell activating bispecific antigen binding molecule of the invention, comprising the steps of a) culturing the host cell of the invention under conditions suitable for the expression of the T cell activating bispecific antigen binding molecule and b) recovering the T cell activating bispecific antigen binding molecule. The invention also encompasses a T cell activating bispecific antigen binding molecule produced by the method of the invention.

The invention further provides a pharmaceutical composition comprising the T cell activating bispecific antigen binding molecule of the invention and a pharmaceutically acceptable carrier.

Also encompassed by the invention are methods of using the T cell activating bispecific antigen binding molecule and pharmaceutical composition of the invention. In one aspect the invention provides a T cell activating bispecific antigen binding molecule or a pharmaceutical composition of the invention for use as a medicament. In one aspect is provided a T cell activating bispecific antigen binding molecule or a pharmaceutical composition according to the invention for use in the treatment of a disease in an individual in need thereof, in a specific embodiment the disease is cancer.

Also provided is the use of a T cell activating bispecific, antigen binding molecule of the invention for the manufacture of a medicament for the treatment of a disease in an individual in need thereof; as well as a method of treating a disease in an individual, comprising administering to said individual a therapeutically effective amount of a composition comprising the T cell activating bispecific antigen binding molecule according to the invention in a pharmaceutically acceptable form. In a specific embodiment the disease is cancer. In any of the above embodiments the individual preferably is a mammal, particularly a human.

The invention also provides a method for inducing lysis of a target cell, particularly a tumor cell, comprising contacting a target cell with a T cell activating bispecific antigen binding molecule of the invention in the presence of a T cell, particularly a cytotoxic T cell.

BRIEF DESCRIPTION OF THE DRAWINGS

FIGS. 1A-1M. Exemplary configurations of the T cell activating bispecific antigen binding molecules (TCBs) of the invention. Illustration of (FIG. 1A) the "1+1 IgG scFab, one armed", and (FIG. 1B) the "1+1 IgG scFab, one armed inverted" molecule. In the "1+1 IgG scFab, one armed" molecule the light chain of the T cell targeting Fab is fused to the heavy chain by a linker, while the "1+1 IgG scFab, one armed inverted" molecule has the linker in the tumor targeting Fab. (FIG. 1C) Illustration of the "2+1 IgG scFab" molecule. (FIG. 1D) Illustration of the "1+1 IgG scFab" molecule. (FIG. 1E) illustration of the "1+1 IgG Crossfab" molecule. (FIG. 1F) Illustration of the "2+1 IgG Crossfab" molecule. (FIG. 1G) Illustration of the "2+1 IgG Crossfab" molecule with alternative order of Crossfab and Fab components ("inverted"). (FIG. 1H) Illustration of the "1+1 IgG Crossfab light chain (LC) fusion" molecule. (FIG. 1I) Illustration of the "1+1 CrossMab" molecule. (FIG. 1J) Illustration of the "2+1 IgG Crossfab, linked light chain" molecule.

(FIG. 1K) Illustration of the "1+1 IgG Crossfab, linked light chain" molecule. (FIG. 1L) Illustration of the "2+1 IgG Crossfab, inverted, linked light chain" molecule. (FIG. 1M) illustration of the "1+1 IgG Crossfab, inverted, linked light chain" molecule. Black dot: optional modification in the Fc domain promoting heterodimerization. FIGS. 2A-2D. SDS PAGE (4-12% Bis/Tris, NuPage Invitrogen, Coomassie-stained) of "1+1 IgG scFab, one armed" (anti-MCSP/anti-huCD3) (see SEQ ID NOs 1, 3, 5), non reduced (FIG. 2A) and reduced (FIG. 2B), and of "1+1 IgG scFab, one armed inverted" (anti-MCSP/anti-huCD3) (see SEQ ID NOs 7, 9, 11), non reduced (FIG. 2C) and reduced (FIG. 2D).

FIGS. 6A-6C. (A, B) SDS PAGE (4-12% Bis/Tris, NuPage Invitrogen, Coomassie-stained) of "1+1 IgG scFab, one armed inverted" (anti-EGFR/anti-huCD3) (see SEQ ID NOs 11, 51, 55), non reduced (FIG. 6A) and reduced (FIG. 6B), (FIG. 6C) Analytical size exclusion chromatography (Superdex 200 10/300 GL GE Healthcare; 2 mM MOPS pH 7.3, 150 mM NaCl, 0.02% w/v) NaCl; 50 µg sample injected) of "1+1 IgG scFab, one armed inverted" (anti-FAP/anti-huCD3).

FIGS. 9A-9C. (FIG. 9A, FIG. 9B) SDS PAGE (4-12% Bis/Tris, NuPage Invitrogen, Coomassie-stained) of "2+1 IgG scFab, P329G LALA" (anti-EGFR/anti-huCD3) (see SEQ ID NOs 45, 47, 53), non reduced (FIG. 9A) and reduced (FIG. 9B). (FIG. 9C) Analytical size exclusion chromatography (Superdex 200 10/300 GL GE Healthcare; 2 mM MOPS pH 7.3, 150 mM NaCl, 0.02% (w/v) NaCl; 50 µg sample injected) of "2+1 IgG scFab, P329G LALA" (anti-EGFR/anti-huCD3).

(FIG. 10A, FIG. 10B) SDS PAGE (4-12% Bis/Tris, NuPage Invitrogen, Coomassie-stained) of "2+1 IgG scFab, P329G LALA" (anti-FAP/anti-huCD3) (see SEQ ID NOs 57, 59, 61), non reduced (FIG. 10A) and reduced (FIG. 10B). (FIG. 10C) Analytical size exclusion chromatography (Superdex 200 10/300 GL GE Healthcare; 2 mM MOPS pH 7.3, 150 mM NaCl, 0.02% (w/v) NaCl; 50 µg sample injected) of "2+1 IgG scFab, P329G LALA" (anti-FAP/anti-huCD3).

FIGS. 11A-11C. (FIG. 11A, FIG. 11B) SDS PAGE (4-12% Tris-Acetate (FIG. 11A) or 4-12% Bis/Tris (FIG. 11B), NuPage Invitrogen, Coomassie-stained) of "1+1 IgG Crossfab, Fc(hole) P329G LALA/Fc(knob) wt" (anti-MCSP/anti-huCD3) (see SEQ ID NOs 5, 29, 31, 33), non reduced (FIG. 11A) and reduced (FIG. 11B), (FIG. 11C) Analytical size exclusion chromatography (Superdex 200 10/300 GL GE Healthcare; 2 mM MOPS pH 7.3, 150 mM NaCl, 0.02% (w/v) NaCl; 50 µg, sample injected) of "1+1 IgG Crossfab, Fc(hole) P329G LALA/Fc(knob) wt" (anti-MCSP/anti-huCD3). FIGS. 12A-12C. (FIG. 12A, FIG. 12B) SDS PAGE (4-12% Bis/Tris, NuPage Invitrogen, Coomassie-stained) of "2+1 IgG Crossfab" (anti-MCSP/anti-huCD3) (see SEQ ID NOs 3, 5, 29, 33), non reduced (FIG. 12A) and reduced (FIG. 12B), (FIG. 12C) Analytical size exclusion chromatography (Superdex 200 10/300 GL GE Healthcare; 2 mM MOPS pH 7.3, 150 mM NaCl, 0.02% (w/v) NaCl; 50 µg sample injected) of "2+1 IgG Crossfab" (anti-MCSP/anti-huCD3).

(FIG. 13A, FIG. 13B) SDS PAGE (4-12% Bis/Tris, NuPage Invitrogen, Coomassie-stained) of "2+1 IgG Crossfab" (anti-MCSP/anti-cyCD3) (see SEQ ID NOs 3, 5, 35, 37), non reduced (FIG. 13A) and reduced (FIG. 13B). (FIG. 13C) Analytical size exclusion chromatography (Superdex 200 10/300 GL GE Healthcare; 2 mM MOPS pH 7.3, 150 mM NaCl, 0.02% (w/v) NaCl; 50 µg sample injected) of "2+1 IgG Crossfab" (anti-MCSP/anti-cyCD3).

FIGS. 14A-14C. (FIG. 14A, FIG. 14B) SDS PAGE (4-12% Bis/Tris, NuPage Invitrogen, Coomassie-stained) of "2+1 IgG Crossfab, inverted" (anti-CEA/anti-huCD3) (see SEQ ID NOs 33, 63, 65, 67), non reduced (FIG. 14A) and reduced (FIG. 14B). (FIG. 14C) Analytical size exclusion chromatography (Superdex 200 10/300 GL GE Healthcare; 2 mM MOPS pH 7.3, 150 mM NaCl, 0.02% (w/v) NaCl; 50 µg sample injected) of "2+1 IgG Crossfab, inverted" (anti-CEA/anti-huCD3).

FIGS. 15A and 15B, (FIG. 15A) Thermal stability of "(scFv)$_2$-Fc" and "(dsscFv)$_2$-Fc" (anti-MCSP (LC007)/anti-huCD3 (V9)). Dynamic Light Scattering, measured in a temperature ramp from 25-75° C. at 0.05° C./min. Black curve: "(scFv)$_2$-Fc"; grey curve: "(dsscFv)$_2$-Fc". (FIG. 15B) Thermal stability of "2+1 IgG scFab" (see SEQ NOs 5, 21, 23) and "2+1 IgG Crossfab" (anti-MCSP/anti-huCD3) (see SEQ ID NOs 3, 5, 29, 33). Dynamic Light Scattering, measured in a temperature ramp from 25-75° C. at 0.05° C./min. Black curve: "2+1 IgG scFab"; grey curve: "2+1 IgG Crossfab". FIGS. 16A and 16B. Biacore assay setup for (FIG. 16A) determination of interaction of various Fc-mutants with human FcγRIIIa, and for (FIG. 16B) simultaneous binding of T cell be specific constructs with tumor target and human CD3γ(G$_4$S)$_5$CD3ε-AcTev-Fc(knob)-Avi/Fc(hole).

(FIG. 17A) "2+1 IgG Crossfab" (see SEQ ID NOs 3, 5, 29, 33), (FIG. 17B) "2+1 IgG scFab" (see SEQ ID NOs 5, 21, 23).

(FIG. 18A) "2+1 IgG scFab" (see SEQ ID NOs 45, 47, 53), (FIG. 18B) "1+1 IgG scFab, one armed" (see SEQ ID NOs 43, 45, 47), (FIG. 18C) "1+1 IgG scFab, one armed inverted" (see SEQ ID NOs 11, 49, 51), and (FIG. 18D) "1+1 IgG scFab" (see SEQ ID NOs 47, 53, 213).

FIGS. 19A and 19B. Binding of the "(scFv)$_2$" molecule (50 nM) to CD3 expressed on Jurkat cells (FIG. 19A), or to MCSP on Colo-38 cells (FIG. 19B) measured by FACS. Mean fluorescence intensity compared to untreated cells and cells stained with the secondary antibody only is depicted.

FIGS. 20A and 20B. Binding of the "2+1 IgG scFab, LALA" (see SEQ ID NOs 5, 17, 19) construct (50 nM) to CD3 expressed on Jurkat cells (FIG. 20A), or to MCSP on Colo-38 cells (FIG. 20B) measured by FACS. Mean fluorescence intensity compared to cells treated with the reference anti-CD3 IgG (as indicated), untreated cells, and cells stained with the secondary antibody only is depicted.

FIGS. 21A and 21B. Binding of the "1+1 IgG scFab, one armed" (see SEQ ID NOs 1, 3, 5) and "1+1 IgG scFab, one armed inverted" (see SEQ ID NOs 7, 9, 11) constructs (50 nM) to CD3 expressed on Jurkat cells (FIG. 21A), or to MCSP on Colo-38 cells (FIG. 21B) measured by FACS. Mean fluorescence intensity compared to cells treated with the reference anti-CD3 or anti-MCSP IgG (as indicated), untreated cells, and cells stained with the secondary antibody only is depicted.

FIGS. 24A and 24B. Surface expression level of the late activation marker CD25 on human T cells after incubation with 1 nM of "2+1 IgG scFab, LALA" (see SEQ ID NOs 5, 17, 19) or "(scFv)$_2$" CD3-MCSP bispecific constructs in the presence or absence of Colo-38 tumor target cells, as indicated (E:T ratio=5:1). Depicted is the expression level of the late activation marker CD25 on CD8$^+$ T cells (FIG. 24A) or on CD4$^+$ T cells (FIG. 24B) after 5 days incubation.

FIGS. 43A and 43B. Flow cytometric analysis of expression levels of CD107a/b, as well as perforin levels in CD8$^+$ T cells that have been treated with different CD3-MCSP bispecific constructs ("2+1 IgG scFab, LALA" (see SEQ ID NOs 5, 17, 19) and "(scFv)$_2$") or corresponding control IgGs in the presence (FIG. 43A) or absence (FIG. 43B) of target cells for 6 h. Human pan T cells were incubated with 9.43 nM of the different molecules in the presence or absence of Colo-38 tumor target cells at an effector to target ratio of 5:1. Monensin was added after the first hour of incubation to increase intracellular protein levels by preventing protein transport. Gates were set either on all CD107a/b positive, perforin-positive or double-positive cells, as depicted.

FIGS. 44A and 44B. Relative proliferation of either CD8$^+$ (FIG. 44A) or CD4$^+$ (FIG. 44B) human T cells upon incubation with 1 nM of different CD3-MCSP bispecific constructs ("2+1 IgG scFab, LALA" (see SEQ ID NOs 5, 17, 19) or "(scFv)?") or corresponding control IgGs in the presence or absence of Colo-38 tumor target cells at an effector to target cell ratio of 5:1. ME-labeled human pan T cells were characterized by FACS. The relative proliferation level was determined by setting a gate around the non-proliferating cells and using the cell number of this gate relative to the overall measured cell number as the reference.

FIGS. 46A-46D. Levels of different cytokines measured in the supernatant of whole blood after treatment with 1 nM of different CD3-MCSP bispecific constructs ("2+1 IgG scFab", "2+1 IgG Crossfab" (see SEQ ID NOs 3, 5, 29, 33) or "(scFv)$_2$") or corresponding control IgGs in the presence (FIG. 46A, FIG. 46B) or absence (FIG. 46C, FIG. 46D) of Colo-38 tumor cells for 24 hours. Among the bispecific constructs were different "2+1 IgG scFab" constructs having either a wild-type Fc domain (see SEQ ID NOs 5, 13, 15), or an Fc domain mutated to abolish (NK) effector cell function (LALA (see SEQ ID NOs 5, 17, 19), P329G LALA (see SEQ ID NOs 5, 2, 23) and P329G LALA N297D (see SEQ ID NOs 5, 25, 27)).

FIGS. 53A and 53B. Surface expression level of the early activation marker CD69 (FIG. 53A) and the late activation marker CD25 (FIG. 53B) on human CD8H$^+$ T cells after 22 hours incubation with 10 nM, 80 pM or 3 pM of different CD3-MCSP bispecific constructs ("2+1 IgG Crossfab" (see SEQ ID NOs 3, 5, 29, 33) and "2+1 IgG Crossfab, linked LC" (see SEQ ID NOs 3, 5, 29, 179)) in the presence or absence of human MCSP-expressing Colo-38 tumor target cells (E:T ratio=10:1).

(FIG. 54A) Electropherogram shown as SDS-PAGE of 1+1 IgG Crossfab; VL/VH exchange (LC007/V9) (see SEQ ID NOs 5, 29, 33, 181): a) non-reduced, b) reduced.

(FIG. 54N) SDS PAGE (4-12% Bis/Tris, NuPage Invitrogen, Coomassie-stained) of "2+1 IgG Crossfab" (anti-CD20/anti-huCD3) (see SEQ ID NOs 33, 227, 229, 231), non-reduced.

FIGS. 55A and 55B. Binding of bispecific constructs (CEA/CD3 "2+1 IgG Crossfab, inverted (VL/VH)" (see SEQ ID NOs 33, 63, 65, 67) and "2+1 IgG Crossfab, inverted (CL/CH1) (see SEQ ID NOs 65, 67, 183, 197)) to human CD3, expressed by Jurkat cells (FIG. 55A), or to human CEA, expressed by LS-174T cells (FIG. 55B) as determined by FACS. As a control, the equivalent maximum concentration of the reference IgGs and the background staining due to the labeled 2ndary antibody (goat anti-human FITC-conjugated AffiniPure F(ab')2 Fragment, Fcγ Fragment-specific, Jackson Immuno Research Lab #109-096-098) were assessed as well.

FIGS. 57A and 57B. Binding of the "1+1 IgG Crossfab light chain fusion" (see SEQ ID NOs 183, 209, 211, 213) to human CD3, expressed by Jurkat cells (FIG. 57A), or to human CEA, expressed by LS-174T cells (FIG. 57B) as determined by FACS.

FIGS. 59A and 59B. Surface expression level of the early activation marker CD69 (FIG. 59A) or the late activation marker CD25 (FIG. 59B) on human CD4$^+$ or CD8$^+$ T cells after 24 hours incubation with the indicated concentrations of the CD3/MCSP "1+1 CrossMab" (see SEQ ID NOs 5, 23, 183, 185), "1+1 IgG Crossfab" (see SEQ ID NOs 5, 29, 33, 181) and "2+1 IgG Crossfab" (see SEQ ID NOs 3, 5, 29, 33) constructs. The assay was performed in the presence or absence of MV-3 target cells, as indicated.

FIGS. 60A and 60B. Surface expression level of the early activation marker CD25 on CD4$^+$ or CD8$^+$ T cells from two different cynomolgus monkeys (FIG. 60A and FIG. 60B) in the presence or absence of huMCSP-positive MV-3 tumor cells upon co-culture with cynomolgus PBMCs (E:T ratio=3:1, normalized to CD3' numbers), treated with the "2+1 IgG Crossfab" (see SEQ ID NOs 5, 23, 215, 217) and the "2+1 IgG Crossfab, inverted" (see SEQ ID NOs 5, 23, 215, 219) for ~41 hours.

FIGS. 61A and 61B. Killing (as measured by LDH release) of MKN-45 (FIG. 61A) or LS-174T (FIG. 61B) tumor cells upon co-culture with human PBMCs (E:T ratio=10:1) and activation for 28 hours by different concentrations of the "2+1 IgG Crossfab, inverted (VL/VH)" (see SEQ ID NOs 33, 63, 65, 67) versus the "2+1 IgG Crossfab, inverted (CL/CH1)" (see SEQ ID NOs 65, 67, 183, 197) construct.

FIGS. 65A and 65B. Killing (as measured by LDH release) of MKN-45 (FIG. 65A) or LS-174T (FIG. 65B) tumor cells upon co-culture with human PBMCs (E:T ratio=10:1) and activation for 28 hours by different concentrations of the "1+1 IgG Crossfab LC fusion" (see SEQ ID NOs 183, 209, 211, 213).

FIGS. 77A-77F. Secretion of IL-2 (FIG. 77A), IFN-γ (FIG. 77B), TNFα (FIG. 77C), IL-4 (FIG. 77D), IL-10 (FIG. 77E) and Granzyme B (FIG. 77F) by human PBMCs after T cell mediated killing of MV3 melanoma cells (E:T=10:1, 24 h incubation) induced by MCSP TCB antibody (SEQ ID NOs 278, 319, 320, 321). "Untargeted TCB": bispecific antibody engaging CD3 but no second antigen.

FIGS. 79A-79C. T-cell killing induced by CEA TCB (SEQ ID NOs 288, 322, 323, 324) of MKN45 (high CEA) (FIG. 79A), LS180 (medium CEA) (FIG. 79B), HT-29 (low CEA) (FIG. 79C) (E:T=10:1, effectors human PBMCs, incubation time 24 h), "Untargeted TCB": bispecific antibody engaging CD3 but no second antigen.

FIGS. 80A-80D. Upregulation of CD25 and CD69 on human CD8+ (FIG. 80A, FIG. 80B) and CD4+ (FIG. 80C, FIG. 80D) T cells after T cell-mediated killing of LS180 colon adenocarcinoma cells (E:T=10:1, 2.4 h incubation) induced by CEA TCB (SEQ ID NOs 288, 322, 323, 324). "Untargeted TCB": bispecific antibody engaging CD3 but no second antigen.

FIG. 84. Alignment of affinity matured anti-MCSP clones compared to the non-matured parental clone (M4-3 ML2).

FIGS. 95A and 95B. Binding of hIgG1 DDKK TCB (SEQ ID NOs 372, 373, 374, 375) to MV-3 melanoma cells (MCSP+) (FIG. 95A) and Jurkat (CD3+ cells) (FIG. 95B).

DETAILED DESCRIPTION OF THE INVENTION

Definitions

Figure 1H:
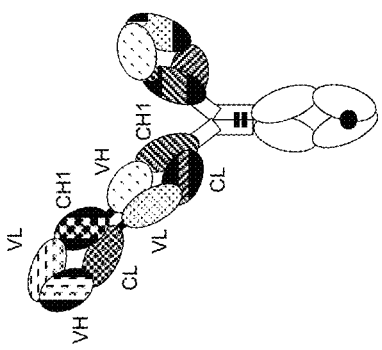
Figure 1I:
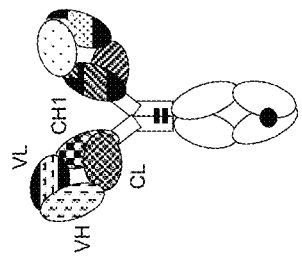
Figure 1J:
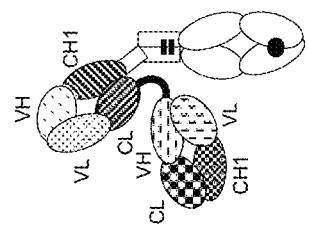
Figure 1K:
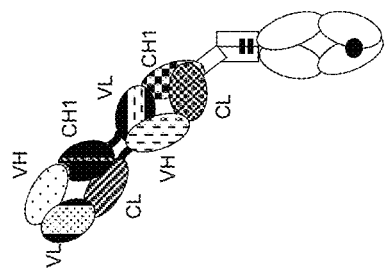
Figure 1L:
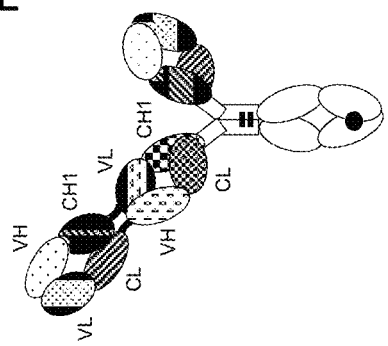
Figure 1M:
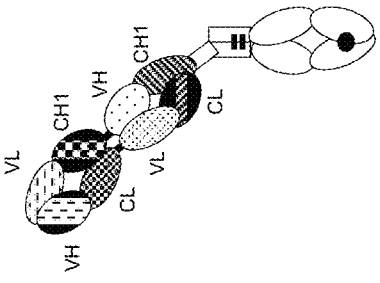
Figure 3A:
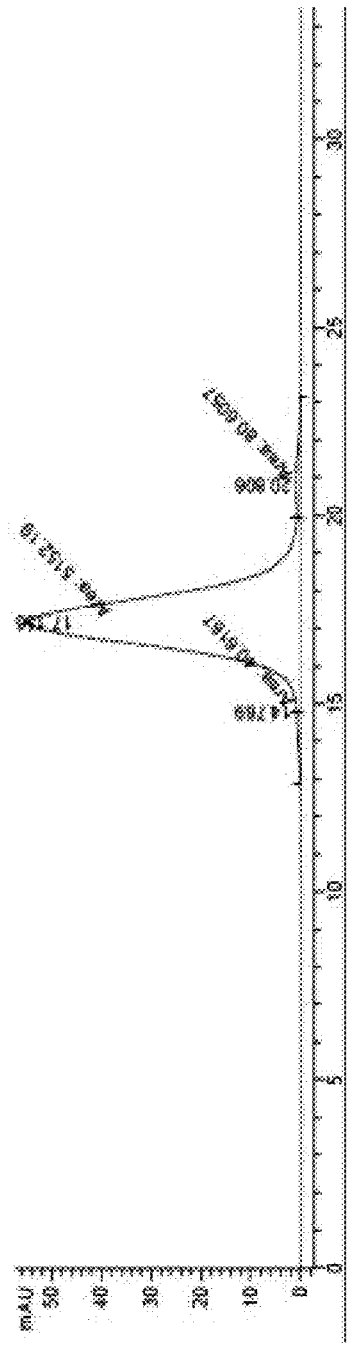
FIGS. 3A and 3B. Analytical size exclusion chromatography (Superdex 200 10/300 GL GE Healthcare; 2 mM MOPS pH 7.3, 150 mM NaCl, 0.02% (w/v) NaCl; 50 µg sample injected) of "1+1 IgG scFab, one armed" (anti-MCSP/anti-huCD3) (see SEQ ID NOs 1, 3, 5) (FIG. 3A) and "1+1 IgG scFab, one armed inverted" (anti-MCSP/anti-huCD3) (see SEQ ID NOs 7, 9, 11) (FIG. 3B).
Figure 3B:
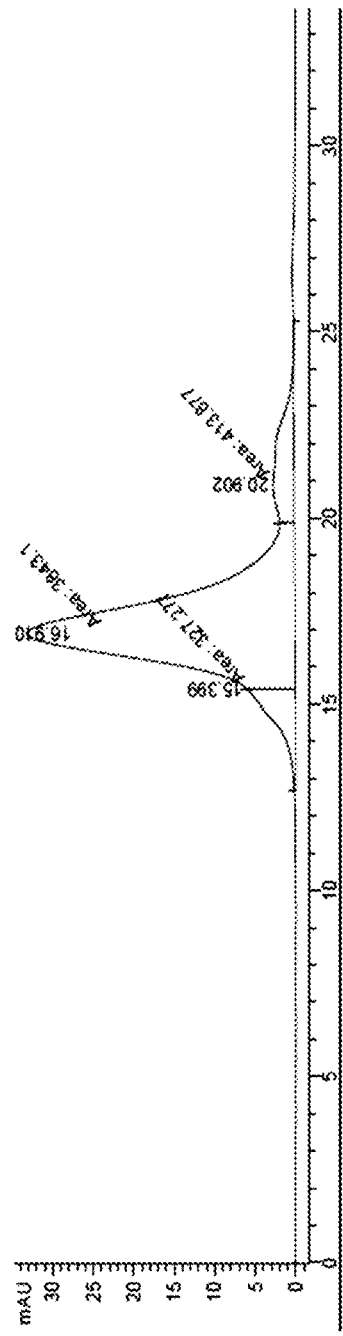
Figure 4A:
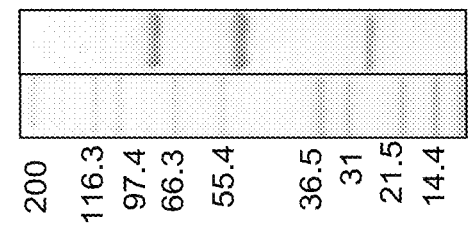
FIGS. 4A-4D. SDS PAGE (4-12% Bis/Tris, NuPage invitrogen, Coomassie-stained) of "1+1 IgG scFab, one armed" (anti-EGFR/anti-huCD3) (see SEQ ID NOs 43, 45, 57), non reduced (FIG. 4A) and reduced (FIG. 4B), and of "1+1 IgG scFab, one armed inverted" (anti-EGFR/anti-huCD3) (see SEQ ID NOs 11, 49, 51), non reduced (FIG. 4C) and reduced (FIG. 4D).
Figure 4B:
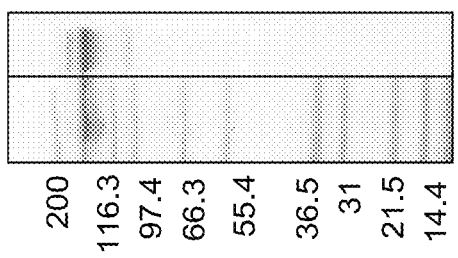
Figure 4C:
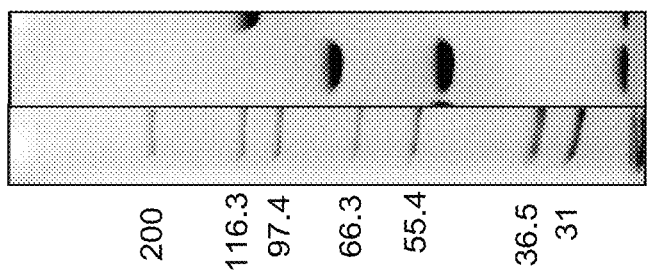
Figure 4D:
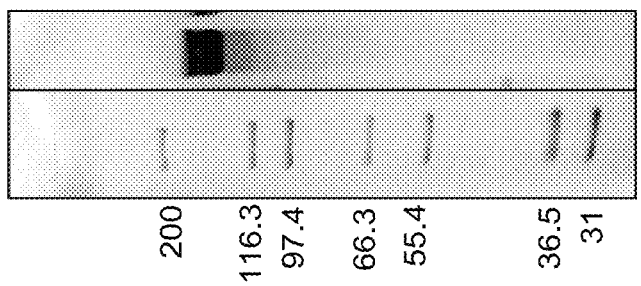
Figure 5A:
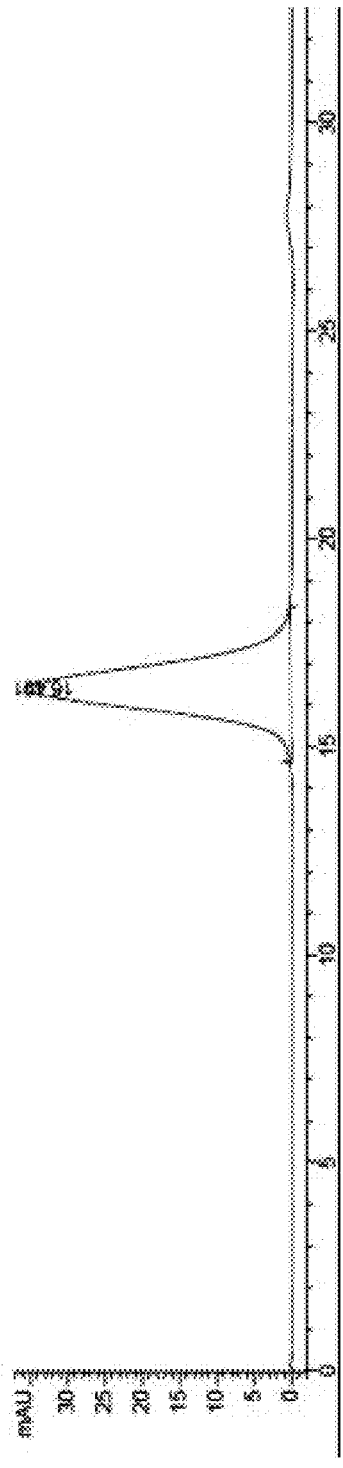
FIGS. 5A and 5B. Analytical size exclusion chromatography (Superdex 200 10/300 GL GE Healthcare; 2 mM MOPS pH 7.3, 150 mM NaCl, 0.02% (w/v) NaCl; 50 µg sample injected) of "1+1 IgG scFab, one armed" (anti-EGFR/anti-huCD3) (see SEQ ID NOs 43, 45, 47) (FIG. 5A) and "1+1 IgG scFab, one armed inverted" (anti-EGFR/anti-huCD3) (see SEQ ID NOs 11, 49, 51) (FIG. 5B).
Figure 5B:
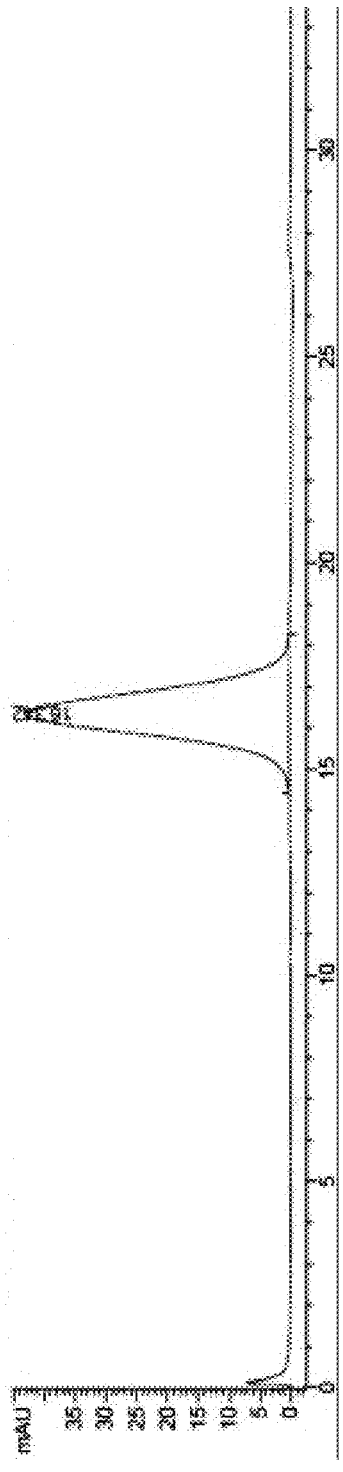
Figure 7C:
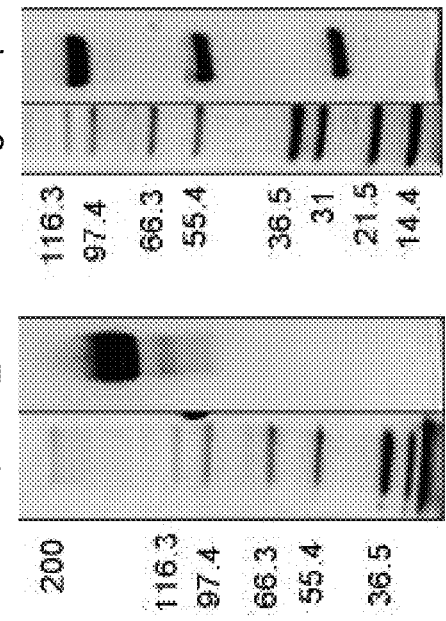
FIGS. 7A-7D SDS PAGE (4-12% Bis/Tris, NuPage Invitrogen, Coomassie-stained) of (FIG. 7A) "2+1 IgG scFab, P329G LALA" (anti-MCSP/anti-huCD3) (see SEQ NOs 5, 21, 23), non reduced (lane 2) and reduced (lane 3); of (FIG. 7B) "2+1 IgG scFab, LALA" (anti-MCSP/anti-huCD3) (see SEQ ID NOs 5, 17, 19), non reduced (lane 2) and reduced (lane 3); of (FIG. 7C) "2+1 IgG scFab, wt" (anti-MCSP/anti-huCD3) (see SEQ ID NOs 5, 13, 15), non reduced (lane 2) and reduced (lane 3); and of (FIG. 7D) "2+1 IgG scFab, P329G LALA N297D" (anti-MCSP/anti-huCD3) (see SEQ ID NOs 5, 25, 27), non reduced (lane 2) and reduced (lane 3).
Figure 7D:
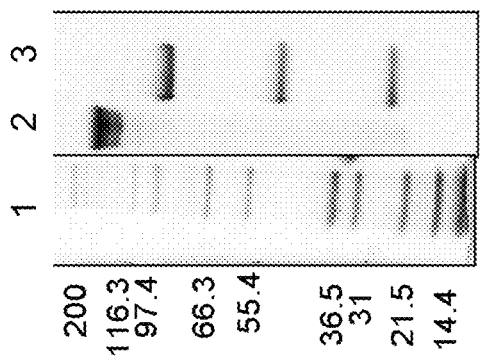
Figure 7B:
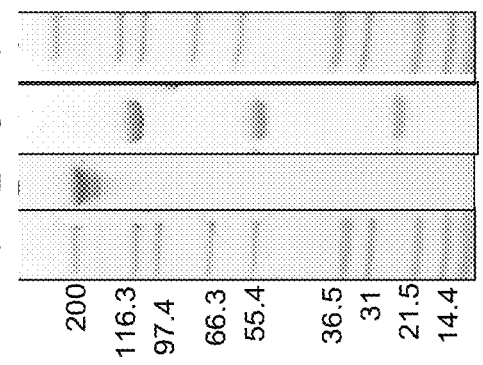
Figure 7A:
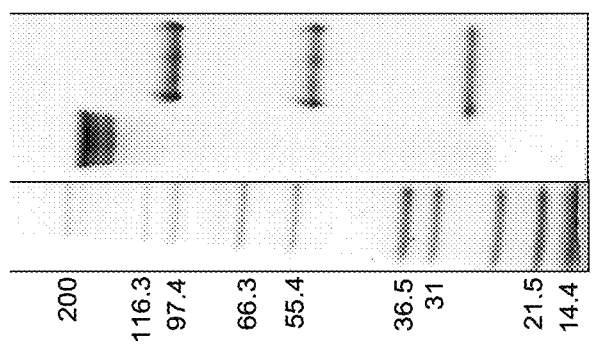
Figure 8A:
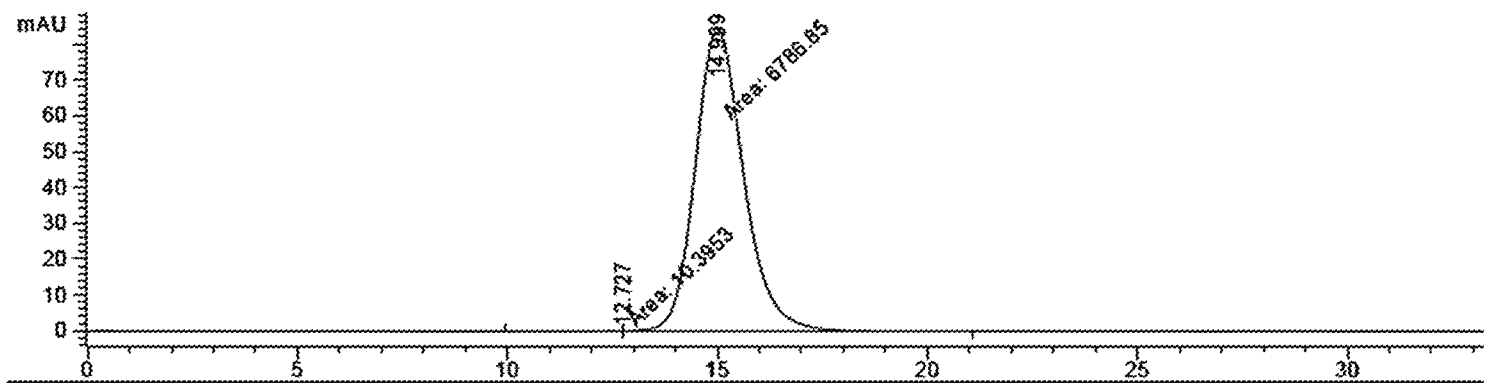
FIGS. 8A-8D. Analytical size exclusion chromatography (Superdex 200 10/300 GL GE Healthcare; 2 mM MOPS pH 7.3, 150 mM NaCl, 0.02% (w/v) NaCl; 50 µg sample injected) of (FIG. 8A) "2+1 IgG scFab, P329G LALA" (anti-MCSP/anti-huCD3) (see SEQ ID NOs 5, 21, 23); of (FIG. 8B) "2+1 IgG scFab, LALA" (anti-MCSP/anti-huCD3) (see SEQ ID NOs 5, 17, 19); of (FIG. 8C) "2+1 IgG scFab, wt" (anti-MCSP/anti-huCD3) (see SEQ ID NOs 5, 13, 15); and of (FIG. 8D) "2±1 IgG scFab, P329G LALA N297D" (anti-MCSP/anti-huCD3) (see SEQ ID NOs 5, 25, 27).
Figure 8B:
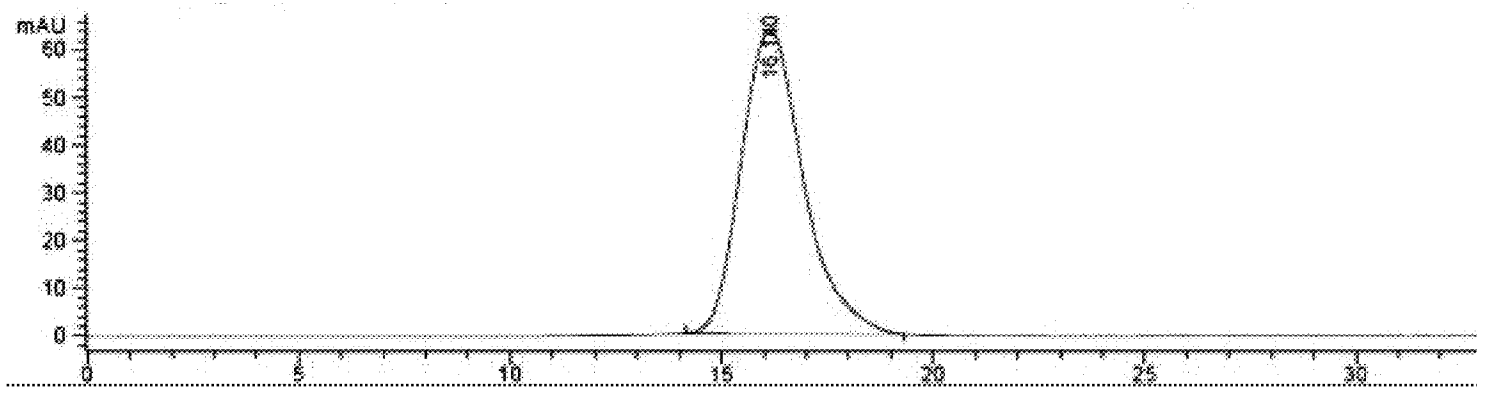
Figure 8C:
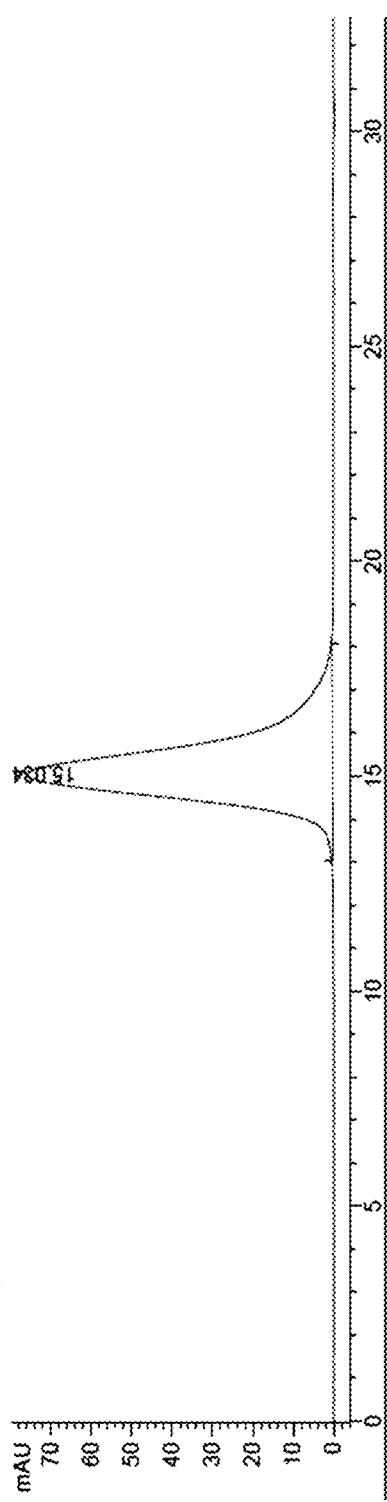
Figure 8D:
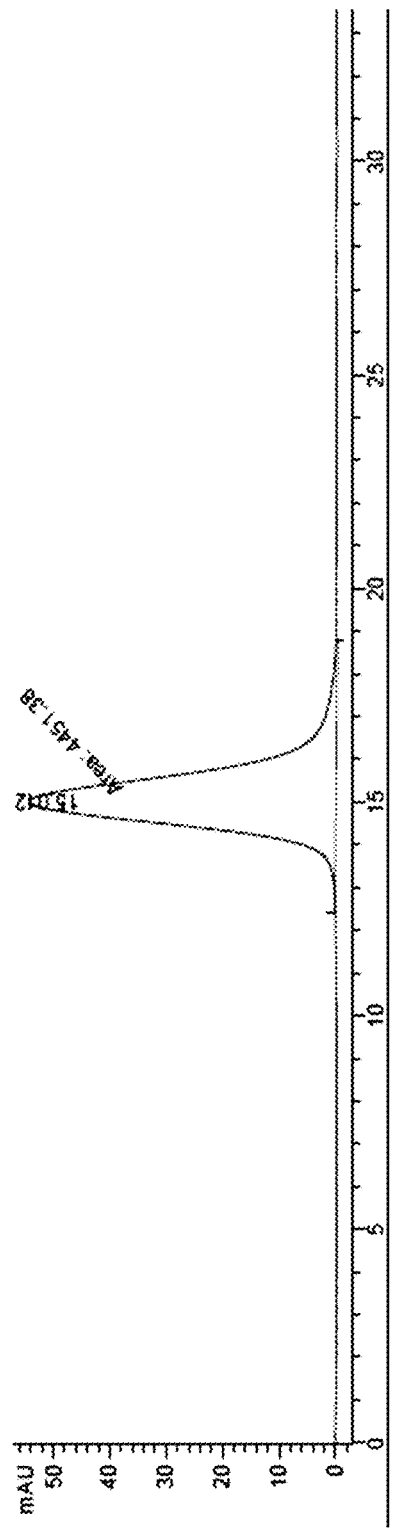
Figure 10B:

FIGS. 10A-10C.
Figure 10A:

Figure 10C:
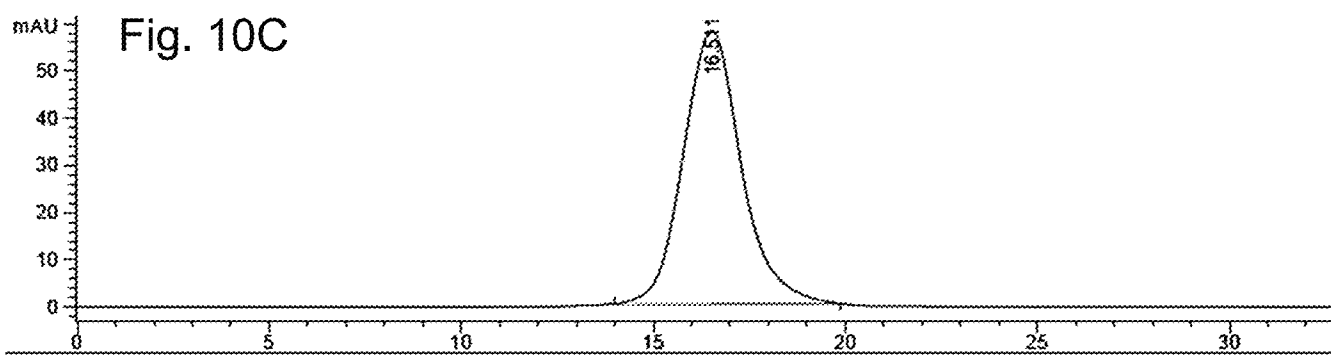
Figure 13B:
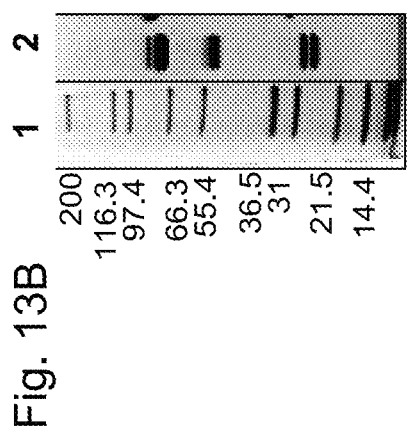
FIGS. 13A-13C.
Figure 13A:
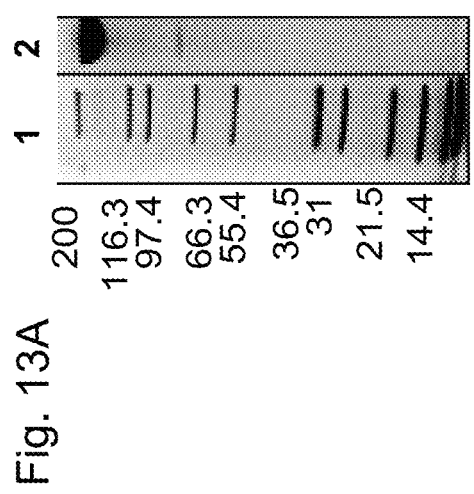
Figure 13C:
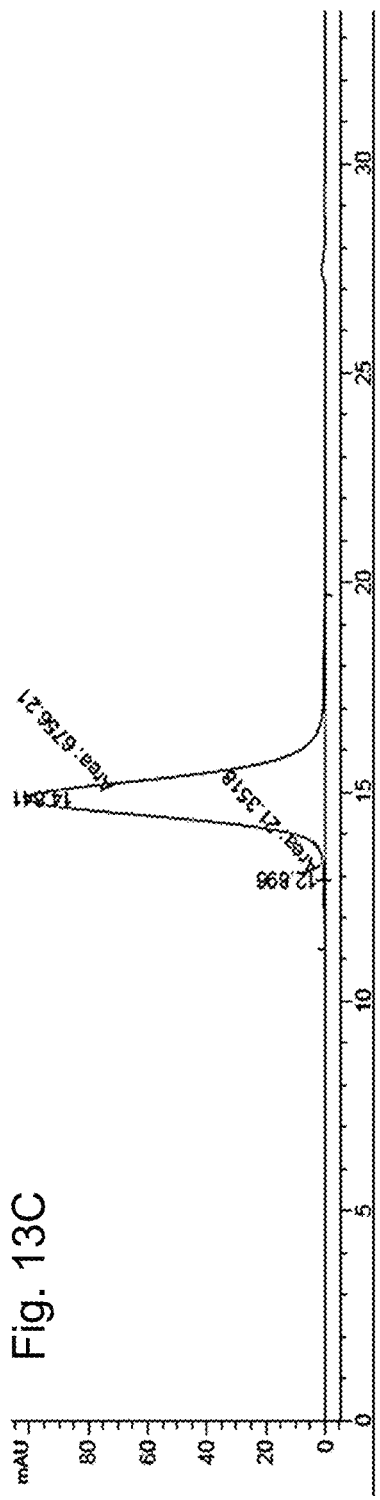

Terms are used herein as generally used in the art, unless otherwise defined in the following.

As used herein, the term "antigen binding molecule" refers in its broadest sense to a molecule that specifically binds an antigenic determinant. Examples of antigen binding molecules are immunoglobulins and derivatives, e.g. fragments, thereof.

The term "bispecific" means that the antigen binding molecule is able to specifically bind to at least two distinct antigenic determinants. Typically, a bispecific antigen binding molecule comprises two antigen binding sites, each of which is specific for a different antigenic determinant. In certain embodiments the bispecific antigen binding molecule is capable of simultaneously binding two antigenic determinants, particularly two antigenic determinants expressed on two distinct cells.

The term "valent" as used herein denotes the presence of a specified number of antigen binding sites in an antigen binding molecule. As such, the term "monovalent binding to an antigen" denotes the presence of one (and not more than one) antigen binding site specific for the antigen in the antigen binding molecule.

An "antigen binding site" refers to the site, i.e. one or more amino acid residues, of an antigen binding molecule which provides interaction with the antigen. For example, the antigen binding site of an antibody comprises amino acid residues from the complementarity determining regions (CDRs). A native immunoglobulin molecule typically has two antigen binding sites, a Fab molecule typically has a single antigen binding site.

As used herein, the term "antigen binding moiety" refers to a polypeptide molecule that specifically binds to an antigenic determinant. In one embodiment, an antigen binding moiety is able to direct the entity to which it is attached (e.g. a second antigen binding moiety) to a target site, for example to a specific type of tumor cell or tumor stroma bearing the antigenic determinant. In another embodiment an antigen binding moiety is able to activate signaling through its target antigen, for example a T cell receptor complex antigen. Antigen binding moieties include antibodies and fragments thereof, as well as binding proteins and scaffolds as further defined herein. Particular antigen binding moieties include an antigen binding domain of an antibody, comprising an antibody heavy chain variable region and an antibody light chain variable region. Other antigen binding moieties include a binding protein comprising at least one ankyrin repeat motif and Single domain antigen binding (SDAB) molecules.

In certain embodiments, the antigen binding moieties may comprise antibody constant regions as further defined herein and known in the art. Useful heavy chain constant regions include any of the five isotypes: α, δ, ε, γ, or μ. Useful light chain constant regions include any of the two isotypes: κ and λ.

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins referred to as antigens herein (e.g. MCSP, FAP, CEA, EGFR, CD33, CD3) can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants. Exemplary human proteins useful as antigens include, but are not limited to: Melanoma-associated Chondroitin Sulfate Proteoglycan (MCSP), also known as Chondroitin Sulfate Proteoglycan 4 (UniProt no. Q6UVK1 (version 70), NCBI RefSeq no. NP_001888.2), Fibroblast Activation Protein (FAP), also known as Seprase (Uni Prot nos. Q12884, Q86Z29, Q99998, NCBI Accession no. NP 004451); Carcinoembryonic antigen (CEA), also known as Carcinoembryonic antigen-related cell adhesion molecule 5 (UniProt no. P06731 (version 119), NCBI RefSeq no. NP_004354.2), CD33, also known as gp67 or Siglec-3 (UniProt no. P20138, NCBI Accession nos. NP_001076087, NP_001171079); Epidermal Growth Factor Receptor (EGFR), also known as ErbB-1 or Her1 (UniProt no. P0053, NCBI Accession nos. NP_958439, NP_958440), and CD3, particularly the epsilon subunit of CD3 (see UniProt no. P07766 (version 130), NCBI RefSeq no. NP_000724.1, SEQ ID NO: 265 for the human sequence; or UniProt no. Q95LI5 (version 49), NCBI GenBank no, BAB71849.1, SEQ ID NO: 266 for the cynomolgus [Macaca fascicularis] sequence). In certain embodiments the T cell activating bispecific antigen binding molecule of the invention binds to an epitope of an activating T cell antigen or a target cell antigen that is conserved among the activating T cell antigen or target antigen from different species.

By "specific binding" is meant that the binding is selective for the antigen and can be discriminated from unwanted or non-specific interactions. The ability of an antigen binding moiety to bind to a specific antigenic determinant can be measured either through an enzyme-linked immunosorbent assay (ELISA) or other techniques familiar to one of skill in the art, e.g. surface plasmon resonance (SPR) technique (analyzed on a BIAcore instrument) (Liljeblad et al., Glyco J 17, 323-329 (2000)), and traditional binding assays (Heeley, Endocr Res 28, 217-229 (2002)). In one embodiment, the extent of binding of an antigen binding moiety to an unrelated protein is less than about 10% of the binding of the antigen binding moiety to the antigen as measured, e.g., by SPR. In certain embodiments, an antigen binding moiety that binds to the antigen, or an antigen binding molecule comprising that antigen binding moiety, has a dissociation constant ($K_D$) of ≤1 μM, ≤100 nM, ≤10 nM, ≤1 nM, ≤0.1 nM, ≤0.01 nM, or ≤0.001 nM (e.g. $10^{-8}$ M or less, e.g. from $10^{-8}$ M to $10^{-13}$ M, e.g., from $10^{-9}$ M to $10^{-13}$ M).

"Affinity" refers to the strength of the sum total of non-covalent interactions between a single binding site of a molecule (e.g., a receptor) and its binding partner (e.g., a ligand). Unless indicated otherwise, as used herein, "binding affinity" refers to intrinsic binding affinity which reflects a 1:1 interaction between members of a binding pair (e.g., an antigen binding moiety and an antigen, or a receptor and its ligand). The affinity of a molecule X for its partner Y can generally be represented by the dissociation constant ($K_D$), which is the ratio of dissociation and association rate constants ($k_{off}$ and $k_{on}$, respectively). Thus, equivalent affinities may comprise different rate constants, as long as the ratio of the rate constants remains the same. Affinity can be measured by well established methods known in the art, including those described herein. A particular method for measuring affinity is Surface Plasmon Resonance (SPR).

"Reduced binding", for example reduced binding to an Fc receptor, refers to a decrease in affinity for the respective interaction, as measured for example by SPR. For clarity the term includes also reduction of the affinity to zero (or below the detection limit of the analytic method), i.e. complete abolishment of the interaction. Conversely, "increased binding" refers to an increase in binding affinity for the respective interaction.

An "activating T cell antigen" as used herein refers to an antigenic determinant expressed on the surface of a T lymphocyte, particularly a cytotoxic T lymphocyte, which is capable of inducing T cell activation upon interaction with an antigen binding molecule. Specifically, interaction of an antigen binding molecule with an activating T cell antigen may induce T cell activation by triggering the signaling cascade of the T cell receptor complex. In a particular embodiment the activating T cell antigen is CD3.

"T cell activation" as used herein refers to one or more cellular response of a T lymphocyte, particularly a cytotoxic T lymphocyte, selected from: proliferation, differentiation, cytokine secretion, cytotoxic effector molecule release, cytotoxic activity, and expression of activation markers. The T cell activating bispecific antigen binding molecules of the invention are capable of inducing T cell activation. Suitable assays to measure T cell activation are known in the art described herein.

A "target cell antigen" as used herein refers to an antigenic determinant presented on the surface of a target cell, for example a cell in a tumor such as a cancer cell or a cell of the tumor stroma.

As used herein, the terms "first" and "second" with respect to antigen binding moieties etc., are used for convenience of distinguishing when there is more than one of each type of moiety. Use of these terms is not intended to confer a specific order or orientation of the T cell activating bispecific antigen binding molecule unless explicitly so stated.

A "Fab molecule" refers to a protein consisting of the VH and CH1 domain of the heavy chain (the "Fab heavy chain") and the VL and CL domain of the light chain (the "Fab light chain") of an immunoglobulin.

By "fused" is meant that the components (e.g. a Fab molecule and an Fc domain subunit) are linked by peptide bonds, either directly or via one or more peptide linkers.

By a "crossover" Fab molecule (also termed "Crossfab") is meant a Fab molecule wherein either the variable regions or the constant regions of the Fab heavy and light chain are exchanged, i.e. the crossover Fab molecule comprises a peptide chain composed of the light chain variable region and the heavy chain constant region, and a peptide chain composed of the heavy chain variable region and the light chain constant region. For clarity, in a crossover Fab molecule wherein the variable regions of the Fab light chain and the Fab heavy chain are exchanged, the peptide chain comprising the heavy chain constant region is referred to herein as the "heavy chain" of the crossover Fab molecule. Conversely, in a crossover Fab molecule wherein the constant regions of the Fab light chain and the Fab heavy chain are exchanged, the peptide chain comprising the heavy chain variable region is referred to herein as the "heavy chain" of the crossover Fab molecule.

The term "immunoglobulin molecule" refers to a protein having the structure of a naturally occurring antibody. For example, immunoglobulins of the IgG class are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a constant light (CL) domain, also called a light chain constant region. The heavy chain of an immunoglobulin may be assigned to one of five types, called α (IgA), δ (IgD), ε (IgE), γ (IgG), or μ (IgM), some of which may be further divided into subtypes, e.g. $\gamma_1$ (IgG$_1$), $\gamma_2$ (IgG$_2$), $\gamma_3$ (IgG$_3$), $\gamma_4$ (IgG$_4$), $\alpha_1$ (IgA$_1$) and $\alpha_2$ (IgA$_2$). The light chain of an immunoglobulin may be assigned to one of two types, called kappa (κ) and lambda (λ), based on the amino acid sequence of its constant domain. An immunoglobulin essentially consists of two Fab molecules and an Fc domain, linked via the immunoglobulin hinge region.

The term "antibody" herein is used in the broadest sense and encompasses various antibody structures, including but not limited to monoclonal antibodies, polyclonal antibodies, and antibody fragments so long as they exhibit the desired antigen-binding activity.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$, diabodies, linear antibodies, single-chain antibody molecules (e.g. scFv), and single-domain antibodies. For a review of certain antibody fragments, see Hudson et al., Nat Med 9, 129-134 (2003), 129-134 (2003). For a review of scFv fragments, see e.g. Pückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')$_2$ fragments comprising salvage receptor binding epitope residues and having increased in vivo half-life, see U.S. Pat. No. 5,869,046. Diabodies are antibody fragments with two antigen-binding sites that may be bivalent or bispecific. See, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see e.g. U.S. Pat. No.

6,248,516 B1). Antibody fragments can be made by various techniques, including but not limited to proteolytic digestion of an intact antibody as well as production by recombinant host cells (e.g. E. coli or phage), as described herein.

The term "antigen binding domain" refers to the part of an antibody that comprises the area which specifically binds to and is complementary to part or all of an antigen. An antigen binding domain may be provided by, for example, one or more antibody variable domains (also called antibody variable regions). Particularly, an antigen binding domain comprises an antibody light chain variable region (VL) and an antibody heavy chain variable region (VH).

The term "binding protein comprising at least one ankyrin repeat motiv" refers to binding proteins as described WO 2002/020565 and WO 2012069655 which are included therein by reference. These binding proteins are also referred to as "DARPins" (an acronym for designed ankyrin repeat proteins) and are genetically engineered antibody mimetic proteins typically exhibiting highly specific and high-affinity target protein binding. They are derived from natural ankyrin proteins and consist of at least one repeat motiv. An exemplary binding protein comprising at least one ankyrin repeat motiv, which targets HER2 is described in Zahnd, C. et al, J. Mol. Biol. (2007) 369, 1015-1028. Furthermore comprised in this invention are other binding proteins such as Fibronectin Type III domain based Adenctins, Lipocalin-based Anticalins, ubiquitin-based Affilins, Transferrin-based Transbodies, Protein A domain based Affibodies, tetranectin domain based TrimerX, Cys-rich domain based MicroProteins, Fyn SH3 domain based Fynomers, EGFR A domain based Avimers, centyrin-based Centyrins, Kuniz domain based kalibitors and other scaffold proteins with randomized binding regions and antibody-like behaviours.

The term "single domain antigen binding molecule" refers to is an antibody fragment consisting of a single monomeric variable antibody domain as described in EP0656946 (included therein by reference in it entirety). Like a whole antibody, it is able to bind selectively to a specific antigen. With a molecular weight of only 12-15 kDa, single-domain antibodies are much smaller than common antibodies (150-160 kDa) which are composed of two heavy protein chains and two light chains, and even smaller than Fab fragments (~50 kDa, one light chain and half a heavy chain) and single-chain variable fragments (~25 kDa, two variable domains, one from a light and one from a heavy chain). In particular the single domain antigen binding molecule is a single domain variable heavy chain consisting of one variable domain (VH), which is also referred to as autonomous variable heavy chain (aVH) antibody. These peptides have similar affinity to antigens as whole antibodies, but are more heat-resistant and stable towards detergents and high concentrations of urea. The comparatively low molecular mass leads to a better permeability in tissues, and to a short plasma half-life since they are eliminated renally.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6$^{th}$ ed., W.H. Freeman and Co., page 91 (2007). A single VH or VL domain may be sufficient to confer antigen-binding specificity.

The term "hypervariable region" or "HVR", as used herein, refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the complementarity determining regions (CDRs), the latter being of highest sequence variability and/or involved in antigen recognition. With the exception of CURL in VH, CDRs generally comprise the amino acid residues that form the hypervariable loops. Hypervariable regions (HVRs) are also referred to as "complementarity determining regions" (CDRs), and these terms are used herein interchangeably in reference to portions of the variable region that form the antigen binding regions. This particular region has been described by Kabat et at, U.S. Dept. of Health and Human Services, Sequences of Proteins of Immunological Interest (1983) and by Chothia et al., J Mol Biol 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The appropriate amino acid residues which encompass the CDRs as defined by each of the above cited references are set forth below in Table A as a comparison. The exact residue numbers which encompass a particular CDR will vary depending on the sequence and size of the CDR. Those skilled in the art can routinely determine which residues comprise a particular CDR given the variable region amino acid sequence of the antibody.

TABLE A

| | CDR Definitions[1] | | |
|---|---|---|---|
| CDR | Kabat | Chothia | AbM[2] |
| $V_H$ CDR1 | 31-35 | 26-32 | 26-35 |
| $V_H$ CDR2 | 50-65 | 52-58 | 50-58 |
| $V_H$ CDR3 | 95-102 | 95-102 | 95-102 |
| $V_L$ CDR1 | 24-34 | 26-32 | 24-34 |
| $V_L$ CDR2 | 50-56 | 50-52 | 50-56 |
| $V_L$ CDR3 | 89-97 | 91-96 | 89-97 |

[1]Numbering of all CDR definitions in Table A is according to the numbering conventions set forth by Kabat et al. (see below).
[2]"AbM" with a lowercase "b" as used in Table A refers to the CDRs as defined by Oxford Molecular's "AbM" antibody modeling software.

Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified, references to the numbering of specific amino acid residue positions in an antibody variable region are according to the Kabat numbering system.

The polypeptide sequences of the sequence listing are not numbered according to the Kabat numbering system. However, it is well within the ordinary skill of one in the art to convert the numbering of the sequences of the Sequence listing to Kabat numbering.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The "class" of an antibody or immunoglobulin refers to the type of constant domain or constant region possessed by its heavy chain. There are five major classes of antibodies: IgA, IgD, IgE, IgG, and IgM, and several of these may be further divided into subclasses (isotypes), e.g., $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ, respectively.

The term "Fc domain" or "Fc region" herein is used to define a C-terminal region of an immunoglobulin heavy chain that contains at least a portion of the constant region. The term includes native sequence Fc regions and variant Fc regions. Although the boundaries of the Fc region of an IgG heavy chain might vary slightly, the human IgG heavy chain Fc region is usually defined to extend from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991. A "subunit" of an Fc domain as used herein refers to one of the two polypeptides forming the dimeric Fc domain, i.e. a polypeptide comprising C-terminal constant regions of an immunoglobulin heavy chain, capable of stable self-association. For example, a subunit of an IgG Fc domain comprises an IgG CH2 and an IgG CH3 constant domain.

A "modification promoting the association of the first and the second subunit of the Fc domain" is a manipulation of the peptide backbone or the post-translational modifications of an Fc domain subunit that reduces or prevents the association of a polypeptide comprising the Fc domain subunit with an identical polypeptide to form a homodimer. A modification promoting association as used herein particularly includes separate modifications made to each of the two Fc domain subunits desired to associate (i.e. the first and the second subunit of the Fc domain), wherein the modifications are complementary to each other so as to promote association of the two Fc domain subunits. For example, a modification promoting association may alter the structure or charge of one or both of the Fc domain subunits so as to make their association sterically or electrostatically favorable, respectively. Thus, (hetero) dimerization occurs between a polypeptide comprising the first Fc domain subunit and a polypeptide comprising the second Fc domain subunit, which might be non-identical in the sense that further components fused to each of the subunits (e.g. antigen binding moieties) are not the same. In some embodiments the modification promoting association comprises an amino acid mutation in the Fc domain, specifically an amino acid substitution. In a particular embodiment, the modification promoting association comprises a separate amino acid mutation, specifically an amino acid substitution, in each of the two subunits of the Fc domain. In one embodiment a modification promoting association of the first and the second subunit of the Fe domain comprises a modification mediating electrostatic steeling effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

The term "effector functions" refers to those biological activities attributable to the Fc region of an antibody, which vary with the antibody isotype. Examples of antibody effector functions include: C1q binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

As used herein, the terms "engineer, engineered, engineering", are considered to include any manipulation of the peptide backbone or the post-translational modifications of a naturally occurring or recombinant polypeptide or fragment thereof. Engineering includes modifications of the amino acid sequence, of the glycosylation pattern, or of the side chain group of individual amino acids, as well as combinations of these approaches.

The term "amino acid mutation" as used herein is meant to encompass amino acid substitutions, deletions, insertions, and modifications. Any combination of substitution, deletion, insertion, and modification can be made to arrive at the final construct, provided that the final construct possesses the desired characteristics, e.g., reduced binding to an Fc receptor, or increased association with another peptide. Amino acid sequence deletions and insertions include amino- and/or carboxy-terminal deletions and insertions of amino acids. Particular amino acid mutations are amino acid substitutions. For the purpose of altering e.g. the binding characteristics of an Fc region, non-conservative amino acid substitutions, i.e. replacing one amino acid with another amino acid having different structural and/or chemical properties, are particularly preferred. Amino acid substitutions include replacement by non-naturally occurring amino acids or by naturally occurring amino acid derivatives of the twenty standard amino acids (e.g. 4-hydroxyproline, 3-methylhistidine, ornithine, homoserine, 5-hydroxylysine). Amino acid mutations can be generated using genetic or chemical methods well known in the art. Genetic methods may include site-directed mutagenesis, PCR, gene synthesis and the like. It is contemplated that methods of altering the side chain group of an amino acid by methods other than genetic engineering, such as chemical modification, may also be useful. Various designations may be used herein to indicate the same amino acid mutation. For example, a substitution from proline at position 329 of the Fc domain to glycine can be indicated as 329G, G329, G329, P329G, or Pro329Gly.

As used herein, term "polypeptide" refers to a molecule composed of monomers (amino acids) linearly linked by amide bonds (also known as peptide bonds). The term "polypeptide" refers to any chain of two or more amino acids, and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide may be derived from a natural biological source or produced by recombinant technology, but is not necessarily translated from a designated nucleic acid sequence. It may be generated in any manner, including by chemical synthesis, A polypeptide of the invention may be of a size of about 3 or more, 5 or more, 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

By an "isolated" polypeptide or a variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for the purpose of the invention, as are native or recombinant polypeptides which have been separated, fractionated, or partially or substantially purified by any suitable technique. "Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA), The term "nucleic acid molecule" refers to any one or more nucleic acid segments, e.g. DNA or RNA fragments, present in a polynucleotide.

By "isolated" nucleic acid molecule or polynucleotide is intended a nucleic acid molecule, DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator. By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof. The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0 cells, YO myeloma cells, P3X63 mouse myeloma cells, PER cells, PER.C6 cells or hybridoma cells, yeast cells, insect cells, and plant cells, to name only a few, but also cells comprised within a transgenic animal, transgenic plant or cultured plant or animal tissue.

An "activating Fc receptor" is an Fc receptor that following engagement by an Fc domain of an antibody elicits signaling events that stimulate the receptor-bearing cell to perform effector functions. Human activating Fc receptors include FcγR (CD16a), FcγRI (CD64), FcγRIIa (CD32), and FcαRI (CD89).

Antibody-dependent cell-mediated cytotoxicity (ADCC) is an immune mechanism leading to the lysis of antibody-coated target cells by immune effector cells. The target cells are cells to which antibodies or derivatives thereof comprising an Fc region specifically bind, generally via the protein part that is N-terminal to the Fc region. As used herein, the term "reduced ADCC" is defined as either a reduction in the number of target cells that are lysed in a given time, at a given concentration of antibody in the medium surrounding the target cells, by the mechanism of ADCC defined above, and/or an increase in the concentration of antibody in the medium surrounding the target cells, required to achieve the lysis of a given number of target cells in a given time, by the mechanism of ADCC. The reduction in ADCC is relative to the ADCC mediated by the same antibody produced by the same type of host cells, using the same standard production, purification, formulation and storage methods (which are known to those skilled in the art), but that has not been engineered. For example the reduction in ADCC mediated by an antibody comprising in its Fc domain an amino acid substitution that reduces ADCC, is relative to the ADCC mediated by the same antibody without this amino acid substitution in the Fc domain. Suitable assays to measure ADCC are well known in the art (see e.g. PCT publication no. WO 2006/082515 or PCT patent application no. PCT/EP2012/055393).

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical composition, other than an active ingredient, which is nontoxic to a subject. A pharmaceutically acceptable carrier includes, but is not limited to, a buffer, excipient, stabilizer, or preservative.

As used herein, "treatment" (and grammatical variations thereof such as "treat" or "treating") refers to clinical intervention in an attempt to alter the natural course of a disease in the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, T cell activating bispecific antigen binding molecules of the invention are used to delay development of a disease or to slow the progression of a disease.

The term "package insert" is used to refer to instructions customarily included in commercial packages of therapeutic products, that contain information about the indications, usage, dosage, administration, combination therapy, contraindications and/or warnings concerning the use of such therapeutic products.

DETAILED DESCRIPTION OF THE EMBODIMENTS

T Cell Activating Bispecific Antigen Binding Molecule Formats

Most antibodies are composed of two heavy and two light chains. Both chains contribute to the antigen-binding site which is usually flat or concave. In addition to these conventional antibodies, llamas, other camelids, and sharks also produce antibodies composed only of heavy chains. The antigen-binding site of these unusual heavy chain antibodies is formed only by a single domain, designated aVH (autonomous variable heavy chain) or single domain variable heavy chain. Single domain variable heavy chains are easily produced as recombinant proteins. Other advantageous features of single domain variable heavy chains include their small size, high solubility, thermal stability, refolding capacity, and good tissue penetration. Single domain antibodies are described e.g. in Wesolowski et al, Med Microbial Immunol (2009) 198:157-174. Methods of producing single domain variable heavy chain antibodies are described e.g. in WO2012152823 and WO2012056000 which is included therein by reference in its entirety.

These single domain variable heavy chain antibodies lack light chains and can also lack the CH1-domain. Therefore, the antigen-binding site of single domain variable heavy chain antibodies is formed only by a single domain.

Single domain antigen binding (SDAB) molecules include molecules whose complementary determining regions are part of a single domain polypeptide. Examples include, but are not limited to, heavy chain variable domains, binding molecules naturally devoid of light chains, Nanobodies™, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, fish, shark, goat, rabbit, and bovine. This term also includes naturally occurring single domain antibody molecules from species other than *Camelidae* and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. ei al. (1993) Nature 363:446-448, for example. For clarity reasons, this variable domain derived from a heavy chain molecule naturally devoid of light chain is known herein as a VHH or Nanobody™ to distinguish it from the conventional VH of four chain immunoglobulins. Such a molecule can be derived from *Camelidae* species, for example in camel, llama, dromedary, alpaca and guanaco. Other species besides *Camelidae* may produce heavy chain molecules naturally devoid of light chain; such VHHs are within the scope of the invention.

SDAB molecules have been described e.g. EP0656946 which is included by reference in its entirety.

The SDAB molecules can be recombinant, CDR-grafted, humanized, camelized, de-immunized and/or in vitro generated (e.g., selected by phage display). A single-domain antibody can be obtained by immunization of dromedaries, camels, llamas, alpacas or sharks with the desired antigen and subsequent isolation of the mRNA coding for heavy-chain antibodies. By reverse transcription and polymerase chain reaction, a gene library of single-domain antibodies containing several million clones is produced. Screening techniques like phage display and ribosome display help to identify the clones binding the antigen. A different method uses gene libraries from animals that have not been immunized beforehand. Such naïve libraries usually contain only antibodies with low affinity to the desired antigen, making it necessary to apply affinity maturation by random mutagenesis as an additional step. When the most potent clones have been identified, their DNA sequence is optimized, for example to improve their stability towards enzymes. Another goal is humanization to prevent immunological reactions of the human organism against the antibody. Humanization is unproblematic because of the homology between camelid VHH and human VH fragments. The final step is the translation of the optimised single-domain antibody in *E. coli, Saccharomyces cerevisiae* or other suitable organisms. Alternatively, single-domain antibodies can be made from common murine or human IgG with four chains. The process is similar, comprising gene libraries from immunized or naïve donors and display techniques for identification of the most specific antigens.

In one embodiment there is provided a T cell activating bispecific antigen binding molecule comprising a first antigen binding moiety capable of specific binding to an activating T cell antigen, and a second antigen binding moiety capable of specific binding to a target cell antigen, wherein said one antigen binding moiety is a crossover Fab molecule wherein either the variable or the constant regions of the Fab light chain and the Fab heavy chain are exchanged and wherein the other antigen binding moiety consists of a single domain antigen binding molecule.

In certain embodiments, a single-domain antigen binding molecule is a human single-domain binding molecule (Domantis, Inc., Waltham, Mass.; see e.g. U.S. Pat. No. 6,248,516 B1).

In one embodiment there is provided a T cell activating bispecific antigen binding molecule comprising a first antigen binding moiety capable of specific binding to an activating T cell antigen, and a second antigen binding moiety capable of specific binding to a target cell antigen, wherein said one antigen binding moiety is a Fab molecule or a crossover Fab molecule wherein either the variable or the constant regions of the Fab light chain and the Fab heavy chain are exchanged and wherein the other antigen binding moiety consists of a single domain variable heavy chain.

In another embodiment there is provided a T cell activating bispecific antigen binding molecule, wherein the first antigen binding moiety capable of specific binding to an activating T cell antigen is a Fab molecule or a crossover Fab molecule wherein either the variable or the constant regions of the Fab light chain and the Fab heavy chain are exchanged and wherein the second antigen binding moiety capable of specific binding to a target cell antigen consists of a single domain variable heavy chain.

The bispecific antibodies of the present invention may comprise one or more crossover-Fab fragment. Crossover Fab fragments are Fab fragments wherein either the variable regions or the constant regions of the heavy and light chain are exchanged. Bispecific antibody formats comprising crossover Fab fragments have been described, for example, in WO2009080252, WO2009080253, WO2009080251, WO2009080254, WO2010/136172, WO2010/145792 and EP patent application No. 11178371.8 which are included by reference therein.

In one embodiment said T cell activating bispecific antigen binding molecule comprises a binding protein comprising a single domain antigen binding molecule, and comprises not more than one antigen binding moiety capable of specific binding to an activating T cell antigen.

In one embodiment said T cell activating bispecific antigen binding molecule comprises one antigen binding moiety comprising a single domain antigen binding molecule, which is fused to another antigen binding moiety comprising a Fab molecule or a crossover Fab molecule wherein either the variable or the constant regions of the Fab light chain and the Fab heavy chain are exchanged. Optionally the antigen binding moieties are fused to each other via a peptide linker.

In one embodiment said single domain antigen binding molecule is fused to the N-terminus of the heavy chain of the crossover Fab molecule.

In one embodiment said single domain antigen binding molecule is fused to the N-terminus of the light chain of the crossover Fab molecule.

In one embodiment said T cell activating bispecific antigen binding molecule additionally comprises a third antigen binding moiety capable of specific binding to a target cell antigen, In one embodiment said third antigen binding moiety capable of specific binding to a target cell antigen is a single domain antigen binding molecule. In one embodiment said third antigen binding moiety capable of specific binding to a target cell antigen is a single domain variable heavy chain as defined above.

In one embodiment of the invention said T cell activating bispecific antigen binding molecule further comprises an Fc domain composed of a first and a second subunit capable of stable association. In one embodiment said Fc domain is an $IgG$, specifically an $IgG_1$ or $IgG_4$, Fc domain. In specific embodiments the Fc domain can further comprise a modification promoting the association of the first and the second subunit of the Fc domain, as outlined below. In other specific embodiments the Fc domain comprises one or more amino acid substitution that reduces binding to an Fc receptor and/or effector function, as outlined below.

In one embodiment said T cell activating bispecific antigen binding molecule comprises
  a) an Fc domain composed of a first and a second subunit capable of stable association,
  b) a first antigen binding moiety comprising a Fab molecule or a crossover Fab molecule wherein either the variable or the constant regions of the Fab light chain and the Fab heavy chain are exchanged, wherein said Fab molecule or crossover Fab molecule is fused at the C-terminus of the Fab heavy chain to the N-terminus of one of the subunits of the Fc domain;
  c) a second antigen binding moiety comprising a single domain variable heavy chain, wherein said single domain variable heavy chain is fused to the N-terminus of one of the subunits of the Fc domain, and
  d) a third antigen binding moiety comprising a single domain variable heavy chain wherein said single domain variable heavy chain is fused to the N-terminus of the Fab heavy chain of the first antigen binding moiety.

In one embodiment said T cell activating bispecific antigen binding molecule comprises
  a) an Fc domain composed of a first and a second subunit capable of stable association,
  b) a first antigen binding moiety capable of specifically binding to an activating T cell antigen, comprising a Fab molecule or a crossover Fab molecule wherein either the variable or the constant regions of the Fab light chain and the Fab heavy chain are exchanged, wherein said Fab molecule or crossover Fab molecule is fused at the C-terminus of the Fab heavy chain to the N-terminus of one of the subunits of the Fc domain;
  c) a second antigen binding moiety capable of specifically binding to a target cell antigen comprising a single domain variable heavy chain, wherein said single domain variable heavy chain is fused to the N-terminus of one of the subunits of the Fc domain, and
  d) a third antigen binding moiety capable of specifically binding to a target cell antigen comprising a single domain variable heavy chain wherein the single domain variable heavy chain is fused to the N-terminus of the Fab heavy chain of the first antigen binding moiety.

In one embodiment said second and third antigen binding moiety bind to the same target cell antigen.

In one embodiment said first and/or second antigen binding moiety is linked directly via a hinge region to the Fe-domain. In another embodiments said first and/or second antigen binding moiety is linked to the Fc-domain via a peptide linker.

According to any of the above embodiments, components of the T cell activating bispecific antigen binding molecule (e.g. antigen binding moiety, Fc domain) may be fused directly or through various linkers, particularly peptide linkers comprising one or more amino acids, typically about 2-20 amino acids, that are described herein or are known in the art. Suitable, non-immunogenic peptide linkers include, for example, $(G_4S)_n$, $(SG_4)_n$, $(G_4S)_n$ or $G_4(SG_4)_n$ peptide linkers, wherein n is generally a number between 1 and 10, typically between 2 and 4.

In one embodiment said T cell activating bispecific antigen binding molecule comprises one or more amino acid sequences that is at least about 80%, 85%, 90%, 95%, 96%, 97%, 98%, 99% or 100% identical to SEQ ID NO: 369, 370 and 371. In another embodiment said T cell activating bispecific antigen binding molecule comprises SEQ ID NOs: 369, 370 and 371.

There are, beside antibodies, other binding proteins or binding domains that can be used to specifically bind a target molecule (e.g. Binz, H. K., Amstutz, P. and Pluckthun, A., Nat. Biotechnol. 23, 1257-1268, 2005). One such novel class of binding proteins or binding domains are based on designed repeat proteins or designed repeat domains (WO 2002/020565; Binz, H. K., Amstutz, P., Kohl, A., Stumpp, M. T., Briand, C, Forrer, P., Grutter, M. G., and Pluckthun, A., Nat. Biotechnol. 22, 575-582, 2004; Stumpp, M. T., Binz, H. K and Amstutz, P., Drug Discov. Today 13, 695-701, 2008).

Ankyrin repeat proteins have been identified in 1987 through sequence comparisons between four such proteins in *Saccharomyces cerevisiae, Drosophila melanogaster* and *Caenorhabditis elegans*. Breeden and Nasmyth reported multiple copies of a repeat unit of approximately 33 residues in the sequences of swi6p, cdcl0p, notch and lin-12. (Breeden and Nasmyth, 1987). The subsequent discovery of 24 copies of this repeat unit in the ankyrin protein led to the naming of this repeat unit as the ankyrin repeat (Lux et al., 1990). Later, this repeat unit has been identified in several hundreds of proteins of different organisms and viruses (Bork, 1993; SMART database, Schultz et al., 2000). These proteins are located in the nucleus, the cytoplasm or the extracellular space. This is consistent with the fact that the ankyrin repeat domain of these proteins is independent of disulfide bridges and thus independent of the oxidation state of the environment. The number of repeat units per protein varies from two to more than twenty (SMART database, Schultz et al., 2000). A minimum number of repeat units seems to be required to form a stable folded domain (Zhang and Peng, 2000). On the other hand, there is also some evidence for an upper limit of six repeat units being present in one folded domain (Michaely and Bennet, 1993).

WO 2002/020565 describes how large libraries of ankyrin repeat proteins can be constructed and their general application. These designed repeat domains harness the modular nature of repeat proteins and possess N-terminal and C-terminal capping modules to prevent the designed repeat domains from aggregation by shielding the hydrophobic core of the domain (Forrer, P., Stumpp, M. T., Binz, H. K. and Pluckthun, A., FEBS letters 539, 2-6, 2003). WO 2012069655 describes optimized repeat proteins by improving the C- or N-terminal capping modules or C- or N-terminal capping repeats of designed ankyrin repeat domains.

Furthermore comprised in this invention are other binding proteins such as Fibronectin Type III domain based Adenctins, Lipocalin-based Anticalins, ubiquitin-based Affilins, Transferrin-based Transbodies, Protein A domain based Affibodies, tetranectin domain based TrimerX, Cys-rich domain based MicroProteins, Fyn SH3 domain based Fynomers, EGFR A domain based Avimers, centyrin-based Centyrins, Kuniz domain based kalibitors and other scaffold proteins with randomized binding regions and antibody-like behaviours.

In one embodiment of the invention, a T cell activating bispecific antigen binding molecule is provided comprising a first antigen binding moiety capable of specific binding to an activating T cell antigen, and a second antigen binding moiety capable of specific binding to a target cell antigen, wherein said one antigen binding moiety is a Fab molecule or a crossover Fab molecule wherein either the variable or the constant regions of the Fab light chain and the Fab heavy chain are exchanged and wherein the other antigen binding moiety is a binding protein comprising at least one ankyrin repeat motiv.

In one preferred embodiment said other antigen binding moiety is a binding protein comprising two ankyrin repeat motifs. In another embodiment said other antigen binding moiety is a binding protein comprising three, four or five ankyrin repeat motifs.

In one embodiment of the invention, a T cell activating bispecific antigen binding molecule is provided comprising a first antigen binding moiety capable of specific binding to an activating T cell antigen, and a second antigen binding moiety capable of specific binding to a target cell antigen, wherein said first antigen binding moiety is a Fab molecule or a crossover Fab molecule wherein either the variable or the constant regions of the Fab light chain and the Fab heavy chain are exchanged and wherein the second antigen binding moiety is a binding protein comprising at least one ankyrin repeat motif.

In one preferred embodiment said second antigen binding moiety is a binding protein comprising two ankyrin repeat motifs. In another embodiment said second antigen binding moiety is a binding protein comprising three, four or five ankyrin repeat motifs.

Preferably said T cell activating bispecific antigen binding molecule comprises a binding protein comprising at least one ankyrin repeat domain, wherein said repeat domain comprises the ankyrin repeat consensus sequence DxxGxTPLHLAaxxGpxpaVpxLLpxGADVNAx, wherein "x" denotes any amino acid," "denotes any amino acid or a deletion," "a" denotes an amino acid with an apolar side chain, and "p" denotes a residue with a polar sidechain. In one embodiment said repeat domain comprises the ankyrin repeat consensus sequence DxxGxTPLHLAxxx GxxxVVxLLLxxGADVNAx, herein "x" denotes any amino acid, in one embodiment said repeat domain comprises the ankyrin repeat sequence motif D1 1G1TPLHLAA1 1GHLEIVEVLLK2GADVNA1, wherein 1 represents an amino acid residue selected from the group: A, D, E, F, H, I, K, L, M, N, Q, R, S, T, V, W and Y; wherein 2 represents an amino acid residue selected from the group: H, N and Y.

The bispecific antibodies of the present invention comprise one or more crossover-Fab fragment. Crossover Fab fragments are Fab fragments wherein either the variable regions or the constant regions of the heavy and light chain are exchanged. Bispecific antibody formats comprising crossover Fab fragments have been described, for example, in WO2009080252, WO2009080253, WO2009080251, WO2009080254, WO2010/136172, WO2010/145792 and EP patent application No. 11178371.8 which are included by reference therein.

In one embodiment said T cell activating bispecific antigen binding molecule comprises a binding protein comprising at least one ankyrin repeat domain, and comprises not more than one antigen binding moiety capable of specific binding to an activating T cell antigen.

In one embodiment said T cell activating bispecific antigen binding molecule comprises one antigen binding moiety comprising a binding protein comprising at least one ankyrin repeat domain, which is fused to another antigen binding moiety comprising a Fab molecule or a crossover Fab molecule wherein either the variable or the constant regions of the Fab light chain and the Fab heavy chain are exchanged. Optionally the antigen binding moieties are fused to each other via a peptide linker.

In one embodiment said binding protein comprising at least one ankyrin repeat domain is fused to the N-terminus of the heavy chain of the crossover Fab molecule.

In one embodiment said binding protein comprising at least one ankyrin repeat domain is fused to the N-terminus of the light chain of the crossover Fab molecule.

In one embodiment said T cell activating bispecific antigen binding molecule additionally comprises a third antigen binding moiety capable of specific binding to a target cell antigen.

In one embodiment said third antigen binding moiety capable of specific binding to a target cell antigen is a binding protein comprising at least one ankyrin repeat motiv. In one embodiment said third antigen binding moiety capable of specific binding to a target cell antigen is a binding protein comprising at least one ankyrin repeat motiv as defined above. In one embodiment said third antigen binding moiety capable of specific binding to a target cell antigen is a binding protein comprising two, three, four our five ankyrin repeat motifs.

In one embodiment of the invention said T cell activating bispecific antigen binding molecule further comprises an Fc domain composed of a first and a second subunit capable of stable association. In one embodiment said Fc domain is an IgG, specifically an IgG1 or IgG4, Fc domain. In specific embodiments the Fc domain can further comprise a modification promoting the association of the first and the second subunit of the Fc domain, as outlined below. In other specific embodiments the Fc domain comprises one or more amino acid substitution that reduces binding to an Fc receptor and/or effector function, as outlined below.

In one embodiment said T cell activating bispecific antigen binding molecule comprises a) an Fc domain composed of a first and a second subunit capable of stable association, b) a first antigen binding moiety comprising a Fab molecule or a crossover Fab molecule wherein either the variable or the constant regions of the Fab light chain and the Fab heavy chain are exchanged, wherein said Fab molecule or crossover Fab molecule is fused at the C-terminus of the Fab heavy chain to the N-terminus of one of the subunits of the Fc domain;

c) a second antigen binding moiety comprising a binding protein comprising at least one ankyrin repeat motiv, wherein said binding protein comprising at least one ankyrin repeat motiv is fused to the N-terminus of one of the subunits of the Fc domain, and d) a third antigen binding moiety comprising binding protein comprising at least one ankyrin repeat motiv wherein binding protein comprising at least one ankyrin repeat motiv is fused to the N-terminus of the Fab heavy chain of the first antigen binding moiety.

In one embodiment said T cell activating bispecific antigen binding molecule comprises an Fc domain composed of a first and a second subunit capable of stable association, b) a first antigen binding moiety capable of specifically binding to an activating T cell antigen, comprising a Fab molecule or a crossover Fab molecule wherein either the variable or the constant regions of the Fab light chain and the Fab heavy chain are exchanged, wherein said Fab molecule or crossover Fab molecule is fused at the C-terminus of the Fab heavy chain to the N-terminus of one of the subunits of the Fc domain;

c) a second antigen binding moiety capable of specifically binding to a target cell antigen comprising a binding protein comprising at least one ankyrin repeat motiv, wherein said binding protein comprising at least one ankyrin repeat motiv is fused to the N-terminus of one of the subunits of the Fc domain, and d) a third antigen binding moiety capable of specifically binding to a target cell antigen comprising binding protein comprising at least one ankyrin repeat motiv wherein binding protein comprising at least one ankyrin repeat motiv is fused to the N-terminus of the Fab heavy chain of the first antigen binding moiety.

In one embodiment said second and third antigen binding moiety bind to the same target cell antigen.

In one embodiment said first and/or second antigen binding moiety is linked directly via a hinge region to the Fc-domain. In another embodiments said first and/or second antigen binding moiety is linked to the Fc-domain via a peptide linker.

According to any of the above embodiments, components of the T cell activating bispecific antigen binding molecule (e.g. antigen binding moiety, Fc domain) may be fused directly or through various linkers, particularly peptide linkers comprising one or more amino acids, typically about 2-20 amino acids, that are described herein or are known in the art. Suitable, non-immunogenic peptide linkers include, for example, $(G_4S)_n$, $(SG_4)_n$, $(G_4S)_n$ or $G_4(SG_4)_n$ peptide linkers, wherein n is generally a number between 1 and 10, typically between 2 and 4.

Fc Domain

In some embodiments of the invention said T cell activating bispecific antigen binding molecule comprises an Fc domain. The Fc domain of the T cell activating bispecific antigen binding molecule consists of a pair of polypeptide chains comprising heavy chain domains of an immunoglobulin molecule. For example, the Fc domain of an immunoglobulin G (IgG) molecule is a dimer, each subunit of which comprises the CH2 and CH3 IgG heavy chain constant domains. The two subunits of the Fc domain are capable of stable association with each other. In one embodiment the T cell activating bispecific antigen binding molecule of the invention comprises not more than one Fc domain.

In one embodiment according the invention the Fc domain of the T cell activating bispecific antigen binding molecule is an IgG Fc domain. In a particular embodiment the Fc domain is an $IgG_1$ Fc domain. In another embodiment the Fc domain is an $IgG_4$ Fc domain. In a more specific embodiment, the Fc domain is an $IgG_4$ Fc domain comprising an amino acid substitution at position S228 (Kabat numbering), particularly the amino acid substitution S228P. This amino acid substitution reduces in vivo Fab arm exchange of $IgG_4$ antibodies (see Stubenrauch et al., Drug Metabolism and Disposition 38, 84-91 (2010)). In a further particular embodiment the Fc domain is human. An exemplary sequence of a human $IgG_1$ Fc region is given in SEQ ID NO: 149.

Fc Domain Modifications Promoting Heterodimerization

T cell activating bispecific antigen binding molecules according to the invention comprise different antigen binding moieties, and in one embodiment are fused to one or the other of the two subunits of the Fc domain, thus the two subunits of the Fc domain are typically comprised in two non-identical polypeptide chains. Recombinant co-expression of these polypeptides and subsequent dimerization leads to several possible combinations of the two polypeptides. To improve the yield and purity of T cell activating bispecific antigen binding molecules in recombinant production, it will thus be advantageous to introduce in the Fc domain of the T cell activating bispecific antigen binding molecule a modification promoting the association of the desired polypeptides.

Accordingly, in particular embodiments the Fc domain of the T cell activating bispecific antigen binding molecule according to the invention comprises a modification promoting the association of the first and the second subunit of the Fc domain. The site of most extensive protein-protein interaction between the two subunits of a human IgG Fc domain is in the CH3 domain of the Fc domain. Thus, in one embodiment said modification is in the CH3 domain of the Fc domain.

In a specific embodiment said modification is a so-called "knob-into-hole" modification, comprising a "knob" modification in one of the two subunits of the Fc domain and a "hole" modification in the other one of the two subunits of the Fc domain.

The knob-into-hole technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). Accordingly, in a particular embodiment, in the CH3 domain of the first subunit of the Fc domain of the T cell activating bispecific antigen binding molecule an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable.

The protuberance and cavity can be made by altering the nucleic acid encoding the polypeptides, e.g. by site-specific mutagenesis, or by peptide synthesis.

In a specific embodiment, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). In one embodiment, in the second subunit of the Fc domain additionally the threonine residue at position 366 is replaced with a serine residue (T366S) and the leucine residue at position 368 is replaced with an alanine residue (L368A).

In yet a further embodiment, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). Introduction of these two cysteine residues results in formation of a disulfide bridge between the two subunits of the Fc domain, further stabilizing the dimer (Carter, J Immunol Methods 248, 7-15 (2001)).

In a particular embodiment the antigen binding moiety capable of binding to an activating T cell antigen is fused (optionally via the antigen binding moiety capable of binding to a target cell antigen) to the first subunit of the Fc domain (comprising the "knob" modification). Without wishing to be bound by theory, fusion of the antigen binding moiety capable of binding to an activating T cell antigen to the knob-containing subunit of the Fc domain will (further) minimize the generation of antigen binding molecules comprising two antigen binding moieties capable of binding to an activating T cell antigen (steric clash of two knob-containing polypeptides).

In one embodiment a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

In one aspect the invention provides a T cell activating bispecific antigen binding molecule comprising a first and a second antigen binding moiety, one of which is a Fab molecule capable of specific binding to an activating T cell antigen and the other one of which is a Fab molecule capable of specific binding to a target cell antigen wherein the first antigen binding moiety is (a) a single chain Fab molecule wherein the Fab light chain and the Fab heavy chain are connected by a peptide linker, or (b) a crossover Fab molecule wherein either the variable or the constant regions of the Fab light chain and the Fab heavy chain are exchanged, and an Fc domain composed of a first and a second subunit capable of stable association, wherein said first subunit and said second subunit have been modified to comprise one or more charged amino acids electrostatically favorable to heterodimer formation.

In one embodiment, said first subunit comprises amino acid mutations E356K, E357K and D399K and said second subunit comprises amino acid mutations K370E, K409E and K439E.

In another embodiment said first subunit comprises amino acid mutations K392D, K409D and said second subunit comprises amino acid mutations E356K, D399K (DDKK).

The components of the T cell activating bispecific antigen binding molecule can be fused to each other in a variety of configurations. Exemplary configurations are depicted in FIG. 1.

In some embodiments, the second antigen binding moiety is fused at the C-terminus of the Fab heavy chain to the N-terminus of the first or the second subunit of the Fc domain.

In a particular such embodiment, the first antigen binding moiety is fused at the C-terminus of the Fab heavy chain to the N-terminus of the Fab heavy chain of the second antigen binding moiety. In a specific such embodiment, the T cell activating bispecific antigen binding molecule essentially consists of a first and a second antigen binding moiety, an Fc domain composed of a first and a second subunit, and optionally one or more peptide linkers, wherein the first antigen binding moiety is fused at the C-terminus of the Fab heavy chain to the N-terminus of the Fab heavy chain of the second antigen binding moiety, and the second antigen binding moiety is fused at the C-terminus of the Fab heavy chain to the N-terminus of the first or the second subunit of the Fc domain. In an even more specific embodiment, the first antigen binding moiety is a single chain Fab molecule. Alternatively, in a particular embodiment, the first antigen binding moiety is a crossover Fab molecule. Optionally, if the first antigen binding moiety is a crossover Fab molecule, the Fab light chain of the first antigen binding moiety and the Fab light chain of the second antigen binding moiety may additionally be fused to each other.

In an alternative such embodiment, the first antigen binding moiety is fused at the C-terminus of the Fab heavy chain to the N-terminus of the first or second subunit of the Fc domain. In a specific such embodiment, the T cell activating bispecific antigen binding molecule essentially consists of a first and a second antigen binding moiety, an Fc domain composed of a first and a second subunit, and optionally one or more peptide linkers, wherein the first and the second antigen binding moiety are each fused at the C-terminus of the Fab heavy chain to the N-terminus of one of the subunits of the Fc domain. In an even more specific embodiment, the first antigen binding moiety is a single chain Fab molecule. Alternatively, in a particular embodiment, the first antigen binding moiety is a crossover Fab molecule.

In yet another such embodiment, the second antigen binding moiety is fused at the C-terminus of the Fab light chain to the N-terminus of the Fab light chain of the first antigen binding moiety. In a specific such embodiment, the T cell activating bispecific antigen binding molecule essentially consists of a first and a second antigen binding moiety, an Fc domain composed of a first and a second subunit, and optionally one or more peptide linkers, wherein the first antigen binding moiety is fused at the N-terminus of the Fab light chain to the C-terminus of the Fab light chain of the second antigen binding moiety, and the second antigen binding moiety is fused at the C-terminus of the Fab heavy chain to the N-terminus of the first or the second subunit of the Fc domain. In an even more specific embodiment, the first antigen binding moiety is a crossover Fab molecule.

In other embodiments, the first antigen binding moiety is fused at the C-terminus of the Fab heavy chain to the N-terminus of the first or second subunit of the Fc domain.

In a particular such embodiment, the second antigen binding moiety is fused at the C-terminus of the heavy chain to the N-terminus of the Fab heavy chain of the first antigen binding moiety. In a specific such embodiment, the T cell activating bispecific antigen binding molecule essentially consists of a first and a second antigen binding moiety, an Fc domain composed of a first and a second subunit, and optionally one or more peptide linkers, wherein the second antigen binding moiety is fused at the C-terminus of the Fab heavy chain to the N-terminus of the Fab heavy chain of the first antigen binding moiety, and the first antigen binding moiety is fused at the C-terminus of the Fab heavy chain to the N-terminus of the first or the second subunit of the Fc domain. In an even more specific embodiment, the first antigen binding moiety is a crossover Fab molecule. Optionally, the Fab light chain of the first antigen binding moiety and the Fab light chain of the second antigen binding moiety may additionally be fused to each other.

In particular of these embodiments, the first antigen binding moiety is capable of specific binding to an activating T cell antigen. In other embodiments, the first antigen binding moiety is capable of specific binding to a target cell antigen.

The antigen binding moieties may be fused to the Fc domain or to each other directly or through a peptide linker, comprising one or more amino acids, typically about 2-20 amino acids. Peptide linkers are known in the art and are described herein. Suitable, non-immunogenic peptide linkers include, for example, $(G_4S)_n$, $(SG_4)_n$, $(G_4)_n$ or $G_4(SG_4)_n$ peptide linkers. "n" is generally a number between 1 and 10, typically between 2 and 4. A particularly suitable peptide linker for fusing the Fab light chains of the first and the second antigen binding moiety to each other is $(G_4S)_2$. An exemplary peptide linker suitable for connecting the Fab heavy chains of the first and the second antigen binding moiety is EPKSC(D)-$(G_4S)_2$ (SEQ ID NOs 150 and 151). Additionally, linkers may comprise (a portion of) an immunoglobulin hinge region. Particularly where an antigen binding moiety is fused to the N-terminus of an Fc domain subunit, it may be fused via an immunoglobulin hinge region or a portion thereof, with or without an additional peptide linker.

A T cell activating bispecific antigen binding molecule with a single antigen binding moiety capable of specific binding to a target cell antigen (for example as shown in FIG. 1. panel A, B, D, E, H, I, K, or M) is useful, particularly in cases where internalization of the target cell antigen is to be expected following binding of a high affinity antigen binding moiety. In such cases, the presence of more than one antigen binding moiety specific for the target cell antigen may enhance internalization of the target cell antigen, thereby reducing its availability.

In many other cases, however, it will be advantageous to have a T cell activating bispecific antigen binding molecule comprising two or more antigen binding moieties specific for a target cell antigen (see examples in shown in FIG. 1. panel C, F, G, J, or L), for example to optimize targeting to the target site or to allow crosslinking of target cell antigens.

Accordingly, in certain embodiments, the T cell activating bispecific antigen binding molecule of the invention further comprises a third antigen binding moiety which is a Fab molecule capable of specific binding to a target cell antigen.

In one embodiment, the third antigen binding moiety is capable of specific binding to the same target cell antigen as the first or second antigen binding moiety. In a particular embodiment, the first antigen binding moiety is capable of specific binding to an activating T cell antigen, and the second and third antigen binding moieties are capable of specific binding to a target cell antigen.

In one embodiment, the third antigen binding moiety is fused at the C-terminus of the Fab heavy chain to the N-terminus of the first or second subunit of the Fc domain. In a particular embodiment, the second and the third antigen binding moiety are each fused at the C-terminus of the Fab heavy chain to the N-terminus of one of the subunits of the Fc domain, and the first antigen binding moiety is fused at the C-terminus of the Fab heavy chain to the N-terminus of the Fab heavy chain of the second antigen binding moiety. In one such embodiment the first antigen binding moiety is a single chain Fab molecule. In a particular such embodiment the first antigen binding moiety is a crossover Fab molecule. Optionally, if the first antigen binding moiety is a crossover Fab molecule, the Fab light chain of the first antigen binding moiety and the Fab light chain of the second antigen binding moiety may additionally be fused to each other.

The second and the third antigen binding moiety may be fused to the Fc domain directly or through a peptide linker. In a particular embodiment the second and the third antigen binding moiety are each fused to the Fc domain through an immunoglobulin hinge region. In a specific embodiment, the immunoglobulin hinge region is a human $IgG_1$ hinge region. In one embodiment the second and the third antigen binding moiety and the Fc domain are part of an immunoglobulin molecule. In a particular embodiment the immunoglobulin molecule is an IgG class immunoglobulin. In an even more particular embodiment the immunoglobulin is an $IgG_1$ subclass immunoglobulin. In another embodiment the immunoglobulin is an $IgG_4$ subclass immunoglobulin. In a further particular embodiment the immunoglobulin is a human immunoglobulin. In other embodiments the immunoglobulin is a chimeric immunoglobulin or a humanized immunoglobulin. In one embodiment, the T cell activating bispecific antigen binding molecule essentially consists of an immunoglobulin molecule capable of specific binding to a target cell antigen, and an antigen binding moiety capable of specific binding to an activating T cell antigen wherein the antigen binding moiety is a single chain Fab molecule or a crossover Fab molecule, particularly a crossover Fab molecule, fused to the N-terminus of one of the immunoglobulin heavy chains, optionally via a peptide linker.

In an alternative embodiment, the first and the third antigen binding moiety are each fused at the C-terminus of the Fab heavy chain to the N-terminus of one of the subunits of the Fc domain, and the second antigen binding moiety is fused at the C-terminus of the Fab heavy chain to the N-terminus of the Fab heavy chain of the first antigen binding moiety. In a specific such embodiment, the T cell activating bispecific antigen binding molecule essentially consists of a first, a second and a third antigen binding moiety, an Fc domain composed of a first and a second subunit, and optionally one or more peptide linkers, wherein the second antigen binding moiety is fused at the C-terminus of the Fab heavy chain to the N-terminus of the Fab heavy chain of the first antigen binding moiety, and the first antigen binding moiety is fused at the C-terminus of the Fab heavy chain to the N-terminus of the first subunit of the Fc domain, and wherein the third antigen binding moiety is fused at the C-terminus of the Fab heavy chain to the N-terminus of the second subunit of the Fc domain. In a particular such embodiment the first antigen binding moiety is a crossover Fab molecule. Optionally, the Fab light chain of the first antigen binding moiety and the Fab light chain of the second antigen binding moiety may additionally be fused to each other.

In some of the T cell activating bispecific antigen binding molecule of the invention, the Fab light chain of the first antigen binding moiety and the Fab light chain of the second antigen binding moiety are fused to each other, optionally via a linker peptide. Depending on the configuration of the first and the second antigen binding moiety, the Fab light chain of the first antigen binding moiety may be fused at its C-terminus to the N-terminus of the Fab light chain of the second antigen binding moiety, or the Fab light chain of the second antigen binding moiety may be fused at its C-terminus to the N-terminus of the Fab light chain of the first antigen binding moiety. Fusion of the Fab light chains of the first and the second antigen binding moiety further reduces mispairing of unmatched Fab heavy and light chains, and also reduces the number of plasmids needed for expression of some of the T cell activating bispecific antigen binding molecules of the invention.

In certain embodiments the T cell activating bispecific antigen binding molecule comprises a polypeptide wherein a first Fab light chain shares a carboxy-terminal peptide bond with a peptide linker, which in turn shares a carboxy-terminal peptide bond with a first Fab heavy chain, which in turn shares a carboxy-terminal peptide bond with an Fc domain subunit (VL-CL-linker-VH—CH1-CH2-CH2(—CH4)), and a polypeptide wherein a second Fab heavy chain shares a carboxy-terminal peptide bond with an Fc domain subunit (VH—CH1-CH2-CH3(—CH4)). In some embodiments the T cell activating bispecific antigen binding molecule further comprises a second Fab light chain polypeptide (VL-CL). In certain embodiments the polypeptides are covalently linked, e.g., by a disulfide bond.

In some embodiments, the T cell activating bispecific antigen binding molecule comprises a polypeptide wherein a first Fab light chain shares a carboxy-terminal peptide bond with a peptide linker, which in turn shares a carboxy-terminal peptide bond with a first Fab heavy chain, which in turn shares a carboxy-terminal peptide bond with a second Fab heavy chain, which in turn shares a carboxy-terminal peptide bond with an Fc domain subunit (VL-CL-linker-VH—CH1-VH—CH1-CH2-CH3(—CH4)). In one of these embodiments that T cell activating bispecific antigen binding molecule further comprises a second Fab light chain polypeptide (VL-CL). The T cell activating bispecific antigen binding molecule according to these embodiments may further comprise (i) an Fc domain subunit polypeptide (CH2-CH3(—CH4)), or (ii) a polypeptide wherein a third Fab heavy chain shares a carboxy-terminal peptide bond with an Fc domain subunit (VH—CH1-CH2-CH3(—CH4)) and a third Fab light chain polypeptide (VL-CL). In certain embodiments the polypeptides are covalently linked, e.g., by a disulfide bond.

In certain embodiments the T cell activating bispecific antigen binding molecule comprises a polypeptide wherein a first Fab light chain variable region shares a carboxy-terminal peptide bond with a first Fab heavy chain constant region (i.e. a crossover Fab heavy chain, wherein the heavy chain variable region is replaced by a light chain variable region), which in turn shares a carboxy-terminal peptide bond with an Fc domain subunit (VL-CH1-CH2-CH2(—CH4)), and a polypeptide wherein a second Fab heavy chain shares a carboxy-terminal peptide bond with an Fc domain subunit (VH—CR1-CH2-CH3(—CH4)). In some embodiments the T cell activating bispecific antigen binding molecule further comprises a polypeptide wherein a Fab heavy chain variable region shares a carboxy-terminal peptide bond with a Fab light chain constant region (VH-CL) and a Fab light chain polypeptide (VL-CL). In certain embodiments the polypeptides are covalently linked, e.g., by a disulfide bond.

In alternative embodiments the T cell activating bispecific antigen binding molecule comprises a polypeptide wherein a first Fab heavy chain variable region shares a carboxy-terminal peptide bond with a first Fab light chain constant region (i.e. a crossover Fab heavy chain, wherein the heavy chain constant region is replaced by a light chain constant region), which in turn shares a carboxy-terminal peptide bond with an Fc domain subunit (VH-CL-CH2-CH2(—CH4)), and a polypeptide wherein a second Fab heavy chain shares a carboxy-terminal peptide bond with an Fc domain subunit (VH—CH1-CH2-CH3(—CH4)). In some embodiments the T cell activating bispecific antigen binding molecule further comprises a polypeptide wherein a Fab light chain variable region shares a carboxy-terminal peptide bond with a Fab heavy chain constant region (VL-CH1) and a Fab light chain polypeptide (VL-CL). In certain embodiments the polypeptides are covalently linked, e.g., by a disulfide bond.

In some embodiments, the T cell activating bispecific antigen binding molecule comprises a polypeptide wherein a first Fab light chain variable region shares a carboxy-terminal peptide bond with a first Fab heavy chain constant region (i.e. a crossover Fab heavy chain, wherein the heavy chain variable region is replaced by a light chain variable region), which in turn shares a carboxy-terminal peptide bond with a second Fab heavy chain, which in turn shares a carboxy-terminal peptide bond with an Fc domain subunit (VL-CH1-VH—CH1-CH2-CH3(—CH4)). In other embodiments, the T cell activating bispecific antigen binding molecule comprises a polypeptide wherein a first Fab heavy chain variable region shares a carboxy-terminal peptide bond with a first Fab light chain constant region (i.e. a crossover Fab heavy chain, wherein the heavy chain constant region is replaced by a light chain constant region), which in turn shares a carboxy-terminal peptide bond with a second Fab heavy chain, which in turn shares a carboxy-terminal peptide bond with an Fc domain subunit (VH-CL-VH—CH1-CH2-CH3(—CH4)). In still other embodiments, the T cell activating bispecific antigen binding molecule comprises a polypeptide wherein a second Fab heavy chain shares a carboxy-terminal peptide bond with a first Fab light chain variable region which in turn shares a carboxy-terminal peptide bond with a first Fab heavy chain constant region (i.e. a crossover Fab heavy chain, wherein the heavy chain variable region is replaced by a light chain variable region), which in turn shares a carboxy-terminal peptide bond with an Fc domain subunit (VH—CH1-VL-CH1-CH2-CH3(—CH4)). In other embodiments, the T cell activating bispecific antigen binding molecule comprises a polypeptide wherein a second Fab heavy chain shares a carboxy-terminal peptide bond with a first Fab heavy chain variable region which in turn shares a carboxy-terminal peptide bond with a first Fab light chain constant region (i.e. a crossover Fab heavy chain, wherein the heavy chain constant region is replaced by a light chain constant region), which in turn shares a carboxy-terminal peptide bond with an Fc domain subunit (VH—CH1-VH-CL-CH2-CH3(—CH4)).

In some of these embodiments the T cell activating bispecific antigen binding molecule further comprises a crossover Fab light chain polypeptide, wherein a Fab heavy chain variable region shares a carboxy-terminal peptide bond with a Fab light chain constant region (VH-CL), and a Fab light chain polypeptide (VL-CL). In others of these embodiments the T cell activating bispecific antigen binding molecule further comprises a crossover Fab light chain polypeptide, wherein a Fab light chain variable region shares a carboxy-terminal peptide bond with a Fab heavy chain constant region (VL-CIII), and a Fab light chain polypeptide (VL-CL). In still others of these embodiments the T cell activating bispecific antigen binding molecule further comprises a polypeptide wherein a Fab light chain variable region shares a carboxy-terminal peptide bond with a Fab heavy chain constant region which in turn shares a carboxy-terminal peptide bond with a Fab light chain polypeptide (VL-CH1-VL-CL), a polypeptide wherein a Fab heavy chain variable region shares a carboxy-terminal peptide bond with a Fab light chain constant region which in turn shares a carboxy-terminal peptide bond with a Fab light chain polypeptide (VH-CL-VL-CL), a polypeptide wherein a Fab light chain polypeptide shares a carboxy-terminal peptide bond with a Fab light chain variable region which in turn shares a carboxy-terminal peptide bond with a Fab heavy chain constant region (VL-CL-VL-CH1), or a polypeptide wherein a Fab light chain polypeptide shares a carboxy-terminal peptide bond with a Fab heavy chain variable region which in turn shares a carboxy-terminal peptide bond with a Fab light chain constant region (VL-CL-VH-CL).

The T cell activating bispecific antigen binding molecule according to these embodiments may further comprise (i) an Fc domain subunit polypeptide (CH2-CH3(—CH4)), or (ii) a polypeptide wherein a third Fab heavy chain shares a carboxy-terminal peptide bond with an Fc domain subunit (VH—CH1-CH2-CH3(—CH4)) and a third Fab light chain polypeptide (VL-CL). In certain embodiments the polypeptides are covalently linked, e.g., by a disulfide bond.

In one embodiment, the T cell activating bispecific antigen binding molecule comprises a polypeptide wherein a second Fab light chain shares a carboxy-terminal peptide bond with a first Fab light chain variable region which in turn shares a carboxy-terminal peptide bond with a first Fab heavy chain constant region (i.e. a crossover Fab light chain, wherein the light chain constant region is replaced by a heavy chain constant region) (VL-CL-VL-CH1), a polypeptide wherein a second Fab heavy chain shares a carboxy-terminal peptide bond with an Fc domain subunit (VH—CH1-CH2-CH3(—CH4)), and a polypeptide wherein a first Fab heavy chain variable region shares a carboxy-terminal peptide bond with a first Fab light chain constant region (VH-CL). In another embodiment, the T cell activating bispecific antigen binding molecule comprises a polypeptide wherein a second Fab light chain shares a carboxy-terminal peptide bond with a first Fab heavy chain variable region which in turn shares a carboxy-terminal peptide bond with a first Fab light chain constant region (i.e. a crossover Fab light chain, wherein the light chain variable region is replaced by a heavy chain variable region) (VL-CL-VH-CL), a polypeptide wherein a second Fab heavy chain shares a carboxy-terminal peptide bond with an Fc domain subunit (VH—CH1-CH2-CH3(—CH4)), and a polypeptide wherein a first Fab light chain variable region shares a carboxy-terminal peptide bond with a first Fab heavy chain constant region (VL-CH1). The T cell activating bispecific antigen binding molecule according to these embodiments may further comprise (i) an Fc domain subunit polypeptide (CH2-CH3(—CH4)), or (ii) a polypeptide wherein a third Fab heavy chain shares a carboxy-terminal peptide bond with an Fc domain subunit (VH—CH1-CH2-CH3(—CH4)) and a third Fab light chain polypeptide (VL-CL). In certain embodiments the polypeptides are covalently linked, e.g., by a disulfide bond.

According to any of the above embodiments, components of the T cell activating bispecific antigen binding molecule (e.g. antigen binding moiety, Fc domain) may be fused directly or through various linkers, particularly peptide linkers comprising one or more amino acids, typically about 2-20 amino acids, that are described herein or are known in the art. Suitable, non-immunogenic peptide linkers include, for example, $(G_4S)_n$, $(SG_4)_n$, $(G_4S)_n$ or $G_4(SG_4)_n$ peptide linkers, wherein n is generally a number between 1 and 10, typically between 2 and 4.

In one embodiment said T cell activating bispecific antigen binding molecule comprises one or more amino acid sequences that is at least about 80%, 85%, 90%, 95%, 96%, 97%, 98%, 99% or 100% identical to SEQ ID NO: 372, 373, 374 and 375. In another embodiment said T cell activating bispecific antigen binding molecule comprises SEQ ID NOs: 372, 373, 374 and 375.

Fc Domain Modifications Reducing Fc Receptor Binding and/or Elector Function

The Fc domain confers to the T cell activating bispecific antigen binding molecule favorable pharmacokinetic properties, including a long serum half-life which contributes to good accumulation in the target tissue and a favorable tissue-blood distribution ratio. At the same time it may, however, lead to undesirable targeting of the cell activating bispecific antigen binding molecule to cells expressing Fc receptors rather than to the preferred antigen-bearing cells. Moreover, the co-activation of Fc receptor signaling pathways may lead to cytokine release which, in combination with the T cell activating properties and the long half-life of the antigen binding molecule, results in excessive activation of cytokine receptors and severe side effects upon systemic administration. Activation of (Fc receptor-bearing) immune cells other than T cells may even reduce efficacy of the cell activating bispecific antigen binding molecule due to the potential destruction of T cells e.g. by NK cells.

Accordingly, in particular embodiments the Fc domain of the T cell activating bispecific antigen binding molecules according to the invention exhibits reduced binding affinity to an Fc receptor and/or reduced effector function, as compared to a native $IgG_1$ Fc domain. In one such embodiment the Fc domain (or the T cell activating bispecific antigen binding molecule comprising said Fe domain) exhibits less than 50%, preferably less than 20%, more preferably less than 10% and most preferably less than 5% of the binding affinity to an Fc receptor, as compared to a native $IgG_1$ Fc domain (or a T cell activating bispecific antigen binding molecule comprising a native $IgG_1$ Fc domain), and/or less than 50%, preferably less than 20%, more preferably less than 10% and most preferably less than 5% of the effector function, as compared to a native $IgG_1$ Fc domain (or a T cell activating bispecific antigen binding molecule comprising a native $IgG_1$ Fc domain). In one embodiment, the Fc domain (or the T cell activating bispecific antigen binding molecule comprising said Fc domain) does not substantially bind to an Fc receptor and/or induce effector function. In a particular embodiment the Fc receptor is an Fcγ receptor. In one embodiment the Fc receptor is a human Fc receptor. In one embodiment the Fc receptor is an activating Fc receptor. In a specific embodiment the Fc receptor is an activating human Fcγ receptor, more specifically human FcγRIIIa, FcγRI or FcγRIIa, most specifically human FcγRIIIa. In one embodiment the effector function is one or more selected from the group of CDC, ADCC, ADCP, and cytokine secretion. In a particular embodiment the effector function is ADCC. In one embodiment the Fc domain exhibits substantially similar binding affinity to neonatal Fc receptor (FcRn), as compared to a native IgG$_1$ Fc domain. Substantially similar binding to FcRn is achieved when the Fc domain (or the T cell activating bispecific antigen binding molecule comprising said Fc domain) exhibits greater than about 70%, particularly greater than about 80%, more particularly greater than about 90% of the binding affinity of a native IgG$_1$ Fc domain (or the T cell activating bispecific antigen binding molecule comprising a native IgG$_1$ Fc domain) to FcRn.

In certain embodiments the Fc domain is engineered to have reduced binding affinity to an Fc receptor and/or reduced effector function, as compared to a non-engineered Fc domain. In particular embodiments, the Fc domain of the T cell activating bispecific antigen binding molecule comprises one or more amino acid mutation that reduces the binding affinity of the Fc domain to an Fc receptor and/or effector function. Typically, the same one or more amino acid mutation is present in each of the two subunits of the Fc domain. In one embodiment the amino acid mutation reduces the binding affinity of the Fc domain to an Fc receptor. In one embodiment the amino acid mutation reduces the binding affinity of the Fc domain to an Fc receptor by at least 2-fold, at least 5-fold, or at least 10-fold. In embodiments where there is more than one amino acid mutation that reduces the binding affinity of the Fc domain to the Fc receptor, the combination of these amino acid mutations may reduce the binding affinity of the Fc domain to an Fc receptor by at least 10-fold, at least 20-fold, or even at least 50-fold. In one embodiment the T cell activating bispecific antigen binding molecule comprising an engineered Fc domain exhibits less than 20%, particularly less than 10%, more particularly less than 5% of the binding affinity to an Fc receptor as compared to a T cell activating bispecific antigen binding molecule comprising a non-engineered Fc domain. In a particular embodiment the Fc receptor is an Fcγ receptor. In some embodiments the Fc receptor is a human Fc receptor. In some embodiments the Fc receptor is an activating Fc receptor. In a specific embodiment the Fc receptor is an activating human Fcγ receptor, more specifically human FcγRIIIa, FcγRI or FcγRIIa, most specifically human FcγRIIIa. Preferably, binding to each of these receptors is reduced. In some embodiments binding affinity to a complement component, specifically binding affinity to C1q, is also reduced. In one embodiment binding affinity to neonatal Fc receptor (FcRn) is not reduced. Substantially similar binding to FcRn, i.e. preservation of the binding affinity of the Fc domain to said receptor, is achieved when the Fc domain (or the T cell activating bispecific antigen binding molecule comprising said Fc domain) exhibits greater than about 70% of the binding affinity of a non-engineered form of the Fc domain (or the T cell activating bispecific antigen binding molecule comprising said non-engineered form of the Fc domain) to FcRn. The Fc domain, or T cell activating bispecific antigen binding molecules of the invention comprising said. Fc domain, may exhibit greater than about 80% and even greater than about 90% of such affinity. In certain embodiments the Fc domain of the T cell activating bispecific antigen binding molecule is engineered to have reduced effector function, as compared to a non-engineered Fc domain. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced crosslinking of target-bound antibodies, reduced dendritic cell maturation, or reduced T cell priming. In one embodiment the reduced effector function is one or more selected from the group of reduced CDC, reduced ADCC, reduced ADCP, and reduced cytokine secretion. In a particular embodiment the reduced effector function is reduced ADCC. In one embodiment the reduced ADCC is less than 20% of the ADCC induced by a non-engineered Fc domain (or a T cell activating bispecific antigen binding molecule comprising a non-engineered Fc domain).

In one embodiment the amino acid mutation that reduces the binding affinity of the Fc domain to an Fc receptor and/or effector function is an amino acid substitution. In one embodiment the Fc domain comprises an amino acid substitution at a position selected from the group of E233, L234, L235, N297, P331 and P329, In a more specific embodiment the Fc domain comprises an amino acid substitution at a position selected from the group of L234, L235 and P329. In some embodiments the Fc domain comprises the amino acid substitutions L234A and L235A. In one such embodiment, the Fc domain is an IgG$_1$ Fc domain, particularly a human IgG$_1$ Fc domain. In one embodiment the Fc domain comprises an amino acid substitution at position P329. In a more specific embodiment the amino acid substitution is P329A or P329G, particularly P329G, in one embodiment the Fc domain comprises an amino acid substitution at position P329 and a further amino acid substitution at a position selected from E233, L234, L235, N297 and P331. In a more specific embodiment the further amino acid substitution is E233P, L234A, L235A, L235E, N297A, N297D or P331S. In particular embodiments the Fc domain comprises amino acid substitutions at positions P329, L234 and L235. In more particular embodiments the Fc domain comprises the amino acid mutations L234A, L235A and P329G ("P329G LALA"). In one such embodiment, the Fc domain is an IgG$_1$ Fc domain, particularly a human IgG$_1$ Fc domain. The "P329G LALA" combination of amino acid substitutions almost completely abolishes Fcγ receptor binding of a human IgG$_1$ Fc domain, as described in PCT patent application no. PCT/EP2012/055393, incorporated herein by reference in its entirety. PCT/EP2012/055393 also describes methods of preparing such mutant Fc domains and methods for determining its properties such as Fc receptor binding or effector functions.

IgG$_4$ antibodies exhibit reduced binding affinity to Fc receptors and reduced effector functions as compared to IgG$_1$ antibodies. Hence, in some embodiments the Fc domain of the T cell activating bispecific antigen binding molecules of the invention is an IgG$_4$ Fc domain, particularly a human IgG$_4$ Fc domain. In one embodiment the IgG$_4$ Fc domain comprises amino acid substitutions at position S228, specifically the amino acid substitution S228P. To further reduce its binding affinity to an Fc receptor and/or its effector function, in one embodiment the IgG$_4$ Fc domain comprises an amino acid substitution at position L235, specifically the amino acid substitution L235E. In another embodiment, the IgG$_4$ Fc domain comprises an amino acid substitution at position P329, specifically the amino acid substitution P329G. In a particular embodiment, the IgG$_4$ Fc domain comprises amino acid substitutions at positions S228, L235 and P329, specifically amino acid substitutions S228P, L235E and P329G. Such IgG$_4$ Fc domain mutants and their Fcγ receptor binding properties are described in PCT patent application no. PCT/EP2012/055393, incorporated herein by reference in its entirety.

In a particular embodiment the Fc domain exhibiting reduced binding affinity to an Fc receptor and/or reduced effector function, as compared to a native IgG$_1$ Fc domain, is a human IgG$_1$ Fc domain comprising the amino acid substitutions L234A, L235A and optionally P329G, or a human IgG$_4$ Fc domain comprising the amino acid substitutions S228P, L235E and optionally P329G.

In certain embodiments N-glycosylation of the Fc domain has been eliminated. In one such embodiment the Fc domain comprises an amino acid mutation at position N297, particularly an amino acid substitution replacing asparagine by alanine (N297A) or aspartic acid (N297D).

In addition to the Fc domains described hereinabove and in PCT patent application no. PCT/EP2012/055393, Fc domains with reduced Fc receptor binding and/or effector function also include those with substitution of one or more of Fc domain residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Mutant Fc domains can be prepared by amino acid deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing.

Binding to Fc receptors can be easily determined e.g. by ELISA, or by Surface Plasmon Resonance (SPR) using standard instrumentation such as a BIAcore instrument (GE Healthcare), and Fc receptors such as may be obtained by recombinant expression. A suitable such binding assay is described herein. Alternatively, binding affinity of Fc domains or cell activating bispecific antigen binding molecules comprising an Fc domain for Fc receptors may be evaluated using cell lines known to express particular Fc receptors, such as human NK cells expressing FcγIIIa receptor.

Effector function of an Fc domain, or a T cell activating bispecific antigen binding molecule comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985); U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g. in a animal model such as that disclosed in Clynes et al., Prot Natl Acad Sci USA 95, 652-656 (1998).

In some embodiments, binding of the Fc domain to a complement component, specifically to C1q, is reduced. Accordingly, in some embodiments wherein the Fc domain is engineered to have reduced effector function, said reduced effector function includes reduced CDC. C1q binding assays may be carried out to determine whether the T cell activating bispecific antigen binding molecule is able to bind C1q and hence has CDC activity. See e.g., C1q and C3c binding ELISA in WO 2006/029879 and WO 2005/100402. To assess complement activation, a CDC assay may be performed (see, for example, Gazzano-Santoro et al., J Immunol Methods 202, 163 (1996); Cragg et al., Blood 101, 1045-1052 (2003); and Cragg and Glennie, Blood 103, 2738-2743 (2004)).

Antigen Binding Moieties

The antigen binding molecule of the invention is bispecific, i.e. it comprises at least two antigen binding moieties capable of specific binding to two distinct antigenic determinants. According to the invention, the antigen binding moieties are Fab molecules (i.e. antigen binding domains composed of a heavy and a light chain, each comprising a variable and a constant region), single domain antigen binding (SDAB) molecules, or protein scaffolds, like binding proteins comprising at least one ankyrin repeat motiv (e.g. Darpins). In one embodiment said Fab molecules or single domain antigen binding (SDAB) molecules are human. In another embodiment said Fab molecules or single domain antigen binding (SDAB) molecules are humanized. In yet another embodiment said Fab molecules comprise human heavy and light chain constant regions.

At least one of the antigen binding moieties is a single chain Fab molecule or a crossover Fab molecule. Such modifications prevent mispairing of heavy and light chains from different Fab molecules, thereby improving the yield and purity of the T cell activating bispecific antigen binding molecule of the invention in recombinant production. In a particular single chain Fab molecule useful for the T cell activating bispecific antigen binding molecule of the invention, the C-terminus of the Fab light chain is connected to the N-terminus of the Fab heavy chain by a peptide linker. The peptide linker allows arrangement of the Fab heavy and light chain to form a functional antigen binding moiety. Peptide linkers suitable for connecting the Fab heavy and light chain include, for example, (G$_4$S)$_6$-GG (SEQ ID NO: 152) or (SG$_3$)$_2$-(SEG$_3$)$_4$-(SG$_3$)-SG (SEQ ID NO:153). In a particular crossover Fab molecule useful for the T cell activating bispecific antigen binding molecule of the invention, the constant regions of the Fab light chain and the Fab heavy chain are exchanged. In another crossover Fab molecule useful for the T cell activating bispecific antigen binding molecule of the invention, the variable regions of the Fab light chain and the Fab heavy chain are exchanged.

In a particular embodiment according to the invention, the T cell activating bispecific antigen binding molecule is capable of simultaneous binding to a target cell antigen, particularly a tumor cell antigen, and an activating T cell antigen. In one embodiment, the T cell activating bispecific antigen binding molecule is capable of crosslinking a T cell and a target cell by simultaneous binding to a target cell antigen and an activating T cell antigen. In an even more particular embodiment, such simultaneous binding results in lysis of the target cell, particularly a tumor cell.

In one embodiment, such simultaneous binding results in activation of the T cell. In other embodiments, such simultaneous binding results in a cellular response of a T lymphocyte, particularly a cytotoxic T lymphocyte, selected from the group of: proliferation, differentiation, cytokine secretion, cytotoxic effector molecule release, cytotoxic activity, and expression of activation markers. In one embodiment, binding of the cell activating bispecific antigen binding molecule to the activating T cell antigen without simultaneous binding to the target cell antigen does not result in T cell activation.

In one embodiment, the T cell activating bispecific antigen binding molecule is capable of re-directing cytotoxic activity of a T cell to a target cell. In a particular embodiment, said re-direction is independent of MHC-mediated peptide antigen presentation by the target cell and and/or specificity of the T cell.

Particularly, a T cell according to any of the embodiments of the invention is a cytotoxic cell. In some embodiments the T cell is a CD4$^+$ or a CD8$^+$ T cell, particularly a CD8$^+$ T cell.

Activating T Cell Antigen Binding Moiety

The T cell activating bispecific antigen binding molecule of the invention comprises at least one antigen binding moiety capable of binding to an activating T cell antigen (also referred to herein as an "activating T cell antigen binding moiety"). In a particular embodiment, the T cell activating bispecific antigen binding molecule comprises not more than one antigen binding moiety capable of specific binding to an activating T cell antigen. In one embodiment the T cell activating bispecific antigen binding molecule provides monovalent binding to the activating T cell antigen. The activating T cell antigen binding moiety can either be a conventional Fab molecule or a modified Fab molecule, i.e. a single chain or crossover Fab molecule, a or single domain antigen binding (SDAB) molecule, or a binding protein comprising at least one ankyrin repeat motif. In embodiments where there is more than one antigen binding moiety capable of specific binding to a target cell antigen comprised in the T cell activating bispecific antigen binding molecule, the antigen binding moiety capable of specific binding to an activating T cell antigen preferably is a modified Fab molecule.

In a particular embodiment the activating T cell antigen is CD3, particularly human CD3 (SEQ ID NO: 265) or cynomolgus CD3 (SEQ ID NO: 266), most particularly human CD3. In a particular embodiment the activating T cell antigen binding moiety is cross-reactive for (i.e. specifically binds to) human and cynomolgus CD3. In some embodiments, the activating T cell antigen is the epsilon subunit of CD3.

In one embodiment, the activating T cell antigen binding moiety can compete with monoclonal antibody H2C (described in PCT publication no. WO2008/119567) for binding an epitope of CD3. In another embodiment, the activating T cell antigen binding moiety can compete with monoclonal antibody V9 (described in Rodrigues et al., Int J Cancer Suppl 7, 45-50 (1992) and U.S. Pat. No. 6,054,297) for binding an epitope of CD3. In yet another embodiment, the activating T cell antigen binding moiety can compete with monoclonal antibody FN18 (described in Nooij et al., Eur J Immunol 19, 981-984 (1986)) for binding an epitope of CD3. In a particular embodiment, the activating T cell antigen binding moiety can compete with monoclonal antibody SP34 (described in Pessano et al., EMBO J 4, 337-340 (1985)) for binding an epitope of CD3. In one embodiment, the activating T cell antigen binding moiety binds to the same epitope of CD3 as monoclonal antibody SP34. In one embodiment, the activating T cell antigen binding moiety comprises the heavy chain CDR1 of SEQ ID NO: 163, the heavy chain CDR2 of SEQ ID NO: 165, the heavy chain CDR3 of SEQ ID NO: 167, the light chain CDR1 of SEQ ID NO: 171, the light chain CDR2 of SEQ ID NO: 173, and the light chain CDR3 of SEQ ID NO: 175. In a further embodiment, the activating T cell antigen binding moiety comprises a heavy chain variable region sequence that is at least about 80%, 85%, 90%, 95%, 96%, 97%, 98%, 99% or 100% identical to SEQ ID NO: 169 and a light chain variable region sequence that is at least about 80%, 85%, 90%, 95%, 96%, 97%, 98%, 99% or 100% identical to SEQ ID NO: 177, or variants thereof that retain functionality.

In one embodiment, the activating T cell antigen binding moiety comprises the heavy chain CDR1 of SEQ ID NO: 249, the heavy chain CDR2 of SEQ ID NO: 251, the heavy chain CDR3 of SEQ ID NO: 253, the light chain CDR1 of SEQ ID NO: 257, the light chain CDR2 of SEQ ID NO: 259, and the light chain CDR3 of SEQ ID NO: 261. In one embodiment, the activating T cell antigen binding moiety can compete for binding an epitope of CD3 with an antigen binding moiety comprising the heavy chain CDR1 of SEQ ID NO: 249, the heavy chain CDR2 of SEQ ID NO: 251, the heavy chain CDR3 of SEQ ID NO: 253, the light chain CDR1 of SEQ ID NO: 257, the light chain CDR2 of SEQ ID NO: 259, and the light chain CDR3 of SEQ ID NO: 261. In one embodiment, the activating T cell antigen binding moiety binds to the same epitope of CD3 as an antigen binding moiety comprising the heavy chain CDR1 of SEQ ID NO: 249, the heavy chain CDR2 of SEQ ID NO: 251, the heavy chain CDR3 of SEQ ID NO: 253, the light chain CDR1 of SEQ ID NO: 257, the light chain CDR2 of SEQ ID NO: 259, and the light chain CDR3 of SEQ ID NO: 261. In a further embodiment, the activating T cell antigen binding moiety comprises a heavy chain variable region sequence that is at least about 80%, 85%, 90%, 95%, 96%, 97%, 98%, 99% or 100% identical to SEQ ID NO: 255 and a light chain variable region sequence that is at least about 80%, 85%, 90%, 95%, 96%, 97%, 98%, 99% or 100% identical to SEQ ID NO: 263, or variants thereof that retain functionality. In one embodiment, the activating T cell antigen binding moiety can compete for binding an epitope of CD3 with an antigen binding moiety comprising the heavy chain variable region sequence of SEQ ID NO: 255 and the light chain variable region sequence of SEQ ID NO: 263. In one embodiment, the activating T cell antigen binding moiety binds to the same epitope of CD3 as an antigen binding moiety comprising the heavy chain variable region sequence of SEQ ID NO: 255 and the light chain variable region sequence of SEQ ID NO: 263. In another embodiment, the activating T cell antigen binding moiety comprises a humanized version of the heavy chain variable region sequence of SEQ ID NO: 255 and a humanized version of the light chain variable region sequence of SEQ ID NO: 263. In one embodiment, the activating T cell antigen binding moiety comprises the heavy chain CDR1 of SEQ ID NO: 249, the heavy chain CDR2 of SEQ ID NO: 251, the heavy chain CDR3 of SEQ ID NO: 253, the light chain CDR1 of SEQ ID NO: 257, the light chain CDR2 of SEQ ID NO: 259, the light chain CDR3 of SEQ ID NO: 261, and human heavy and light chain variable region framework sequences.

In one embodiment the activating T cell antigen binding moiety comprises at least one heavy chain complementarity determining region (CDR) selected from the group consisting of SEQ ID NO: 270, SEQ ID NO: 271 and SEQ ID NO: 272 and at least one light chain CDR selected from the group of SEQ ID NO: 274, SEQ ID NO: 275, SEQ ID NO: 276.

In one embodiment the activating T cell antigen binding moiety comprises a variable heavy chain comprising an amino acid sequence selected from the group of: SEQ ID NO: 269, SEQ ID NO: 298 and SEQ ID NO: 299 and a variable light chain comprising an amino acid sequence selected from the group of: SEQ ID NO: 273 and SEQ ID NO: 297.

In one embodiment the activating T cell antigen binding moiety comprises a variable heavy chain comprising an amino acid sequence of SEQ ID NO: 269 and a variable light chain comprising an amino acid sequence of SEQ ID NO: 273.

Target Cell Antigen Binding Moiety

The T cell activating bispecific antigen binding molecule of the invention comprises at least one antigen binding moiety capable of binding to a target cell antigen (also referred to herein as an "target cell antigen binding moiety"). In certain embodiments, the T cell activating bispecific antigen binding molecule comprises two antigen binding moieties capable of binding to a target cell antigen. In a particular such embodiment, each of these antigen binding moieties specifically binds to the same antigenic determinant. In one embodiment the T cell activating bispecific antigen binding molecule comprises not more than two antigen binding moieties capable of binding to a target cell antigen.

The target cell antigen binding moiety can either be a conventional Fab molecule or a modified Fab molecule, i.e. a single chain or crossover Fab molecule, a or single domain antigen binding (SDAB) molecule, or a binding protein comprising at least one ankyrin repeat motif. The target cell antigen binding moiety binds to a specific antigenic determinant and is able to direct the T cell activating bispecific antigen binding molecule to a target site, for example to a specific type of tumor cell that bears the antigenic determinant.

In certain embodiments the target cell antigen binding moiety is directed to an antigen associated with a pathological condition, such as an antigen presented on a tumor cell or on a virus-infected cell. Suitable antigens are cell surface antigens, for example, but not limited to, cell surface receptors. In particular embodiments the antigen is a human antigen. In a specific embodiment the target cell antigen is selected from the group of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

In particular embodiments the T cell activating bispecific antigen binding molecule comprises at least one antigen binding moiety that is specific for Melanoma-associated Chondroitin Sulfate Proteoglycan (MCSP). In one embodiment the T cell activating bispecific antigen binding molecule comprises at least one, typically two or more antigen binding moieties that can compete with monoclonal antibody LC007 (see SEQ ID NOs 75 and 83, and European patent application no. EP 11178393.2, incorporated herein by reference in its entirety) for binding to an epitope of MCSP. In one embodiment, the antigen binding moiety that is specific for MCSP comprises the heavy chain CDR1 of SEQ ID NO: 69, the heavy chain CDR2 of SEQ ID NO: 71, the heavy chain CDR3 of SEQ ID NO: 73, the light chain CDR1 of SEQ ID NO: 77, the light chain CDR2 of SEQ ID NO: 79, and the light chain CDR3 of SEQ ID NO: 81. In a further embodiment, the antigen binding moiety that is specific for MCSP comprises a heavy chain variable region sequence that is at least about 80%, 85%, 90%, 95%, 96%, 97%, 98%, 99% or 100% identical to SEQ ID NO: 75 and a light chain variable region sequence that is at least about 80?, 85%, 90%, 95%, 96%, 97%, 98%, 99% or 100% identical to SEQ ID NO: 83, or variants thereof that retain functionality. In particular embodiments the T cell activating bispecific antigen binding molecule comprises at least one, typically two or more antigen binding moieties that can compete with monoclonal antibody M4-3 ML2 (see SEQ ID NOs 239 and 247, and European patent application no. EP 11178393.2, incorporated herein by reference in its entirety) for binding to an epitope of MCSP. In one embodiment, the antigen binding moiety that is specific for MCSP binds to the same epitope of MCSP as monoclonal antibody M4-3 ML2. In one embodiment, the antigen binding moiety that is specific for MCSP comprises the heavy chain CDR1 of SEQ ID NO: 233, the heavy chain CDR2 of SEQ ID NO: 235, the heavy chain CDR3 of SEQ ID NO: 237, the light chain CDR1 of SEQ ID NO: 241, the light chain CDR2 of SEQ ID NO: 243, and the light chain CDR3 of SEQ ID NO: 245. In a further embodiment, the antigen binding moiety that is specific for MCSP comprises a heavy chain variable region sequence that is at least about 80%, 85%, 90%, 95%, 96%, 97%, 98%, 99% or 100%, particularly about 98%, 99% or 100%, identical to SEQ ID NO: 239 and a light chain variable region sequence that is at least about 80%, 85%, 90%, 95%, 96%, 97%, 98%, 99% or 100%, particularly about 98%, 99% or 100%, identical to SEQ ID NO: 247, or variants thereof that retain functionality. In one embodiment, the antigen binding moiety that is specific for MCSP comprises the heavy and light chain variable region sequences of an affinity matured version of monoclonal antibody M4-3 ML2. In one embodiment, the antigen binding moiety that is specific for MCSP comprises the heavy chain variable region sequence of SEQ ID NO: 239 with one, two, three, four, five, six or seven, particularly two, three, four or five, amino acid substitutions; and the light chain variable region sequence of SEQ ID NO: 247 with one, two, three, four, five, six or seven, particularly two, three, four or five, amino acid substitutions. Any amino acid residue within the variable region sequences may be substituted by a different amino acid, including amino acid residues within the CDR regions, provided that that binding to MCSP, particularly human MCSP, is preserved. Preferred variants are those having a binding affinity for MCSP at least equal (or stronger) to the binding affinity of the antigen binding moiety comprising the unsubstituted variable region sequences.

In one embodiment the T cell activating bispecific antigen binding molecule comprises the polypeptide sequence of SEQ ID NO: 1, the polypeptide sequence of SEQ ID NO: 3 and the polypeptide sequence of SEQ ID NO: 5, or variants thereof that retain functionality. In a further embodiment the T cell activating bispecific antigen binding molecule comprises the polypeptide sequence of SEQ ID NO: 7, the polypeptide sequence of SEQ ID NO: 9 and the polypeptide sequence of SEQ ID NO: 11, or variants thereof that retain functionality, in yet another embodiment the T cell activating bispecific antigen binding molecule comprises the polypeptide sequence of SEQ ID NO: 13, the polypeptide sequence of SEQ ID NO: 15 and the polypeptide sequence of SEQ ID NO: 5, or variants thereof that retain functionality. In yet another embodiment the T cell activating bispecific antigen binding molecule comprises the polypeptide sequence of SEQ ID NO: 17, the polypeptide sequence of SEQ ID NO: 19 and the polypeptide sequence of SEQ ID NO: 5, or variants thereof that retain functionality. In another embodiment the T cell activating bispecific antigen binding molecule comprises the polypeptide sequence of SEQ ID NO: 21, the polypeptide sequence of SEQ ID NO: 23 and the polypeptide sequence of SEQ ID NO: 5, or variants thereof that retain functionality. In still another embodiment the T cell activating bispecific antigen binding molecule comprises the polypeptide sequence of SEQ ID NO: 25, the polypeptide sequence of SEQ ID NO: 27 and the polypeptide sequence of SEQ ID NO: 5, or variants thereof that retain functionality. In another embodiment the T cell activating bispecific antigen binding molecule comprises the polypeptide sequence of SEQ ID NO: 29, the polypeptide sequence of SEQ ID NO: 31, the polypeptide sequence of SEQ ID NO: 33, and the polypeptide sequence of SEQ ID NO: 5, or variants thereof that retain functionality. In another embodiment the T cell activating bispecific antigen binding molecule comprises the polypeptide sequence of SEQ ID NO: 29, the polypeptide sequence of SEQ ID NO: 3, the polypeptide sequence of SEQ ID NO: 33, and the polypeptide sequence of SEQ ID NO: 5, or variants thereof that retain functionality. In another embodiment the T cell activating bispecific antigen binding molecule comprises the polypeptide sequence of SEQ ID NO: 35, the polypeptide sequence of SEQ ID NO: 3, the polypeptide sequence of SEQ ID NO: 37, and the polypeptide sequence of SEQ ID NO: 5, or variants thereof that retain functionality. In another embodiment the T cell activating bispecific antigen binding molecule comprises the polypeptide sequence of SEQ ID NO: 39, the polypeptide sequence of SEQ ID NO: 3, the polypeptide sequence of SEQ ID NO: 41, and the polypeptide sequence of SEQ ID NO: 5, or variants thereof that retain functionality. In yet another embodiment the T cell activating bispecific antigen binding molecule comprises the polypeptide sequence of SEQ ID NO: 29, the polypeptide sequence of SEQ ID NO: 3, the polypeptide sequence of SEQ ID NO: 5 and the polypeptide sequence of SEQ ID NO: 179, or variants thereof that retain functionality. In one embodiment the T cell activating bispecific antigen binding molecule comprises the polypeptide sequence of SEQ ID NO: 5, the polypeptide sequence of SEQ ID NO: 29, the polypeptide sequence of SEQ ID NO: 33 and the polypeptide sequence of SEQ ID NO: 181, or variants thereof that retain functionality. In one embodiment the T cell activating bispecific antigen binding molecule comprises the polypeptide sequence of SEQ ID NO: 5, the polypeptide sequence of SEQ ID NO: 23, the polypeptide sequence of SEQ NO: 183 and the polypeptide sequence of SEQ ID NO: 185, or variants thereof that retain functionality. In one embodiment the T cell activating bispecific antigen binding molecule comprises the polypeptide sequence of SEQ ID NO: 5, the polypeptide sequence of SEQ ID NO: 23, the polypeptide sequence of SEQ ID NO: 183 and the polypeptide sequence of SEQ ID NO: 187, or variants thereof that retain functionality. In one embodiment the T cell activating bispecific antigen binding molecule comprises the polypeptide sequence of SEQ ID NO: 33, the polypeptide sequence of SEQ ID NO: 189, the polypeptide sequence of SEQ ID NO: 191 and the polypeptide sequence of SEQ ID NO: 193, or variants thereof that retain functionality. In one embodiment the T cell activating bispecific antigen binding molecule comprises the polypeptide sequence of SEQ ID NO: 183, the polypeptide sequence of SEQ ID NO: 189, the polypeptide sequence of SEQ ID NO: 193 and the polypeptide sequence of SEQ ID NO: 195, or variants thereof that retain functionality. In one embodiment the T cell activating bispecific antigen binding molecule comprises the polypeptide sequence of SEQ ID NO: 189, the polypeptide sequence of SEQ ID NO: 193, the polypeptide sequence of SEQ ID NO: 199 and the polypeptide sequence of SEQ ID NO: 201, or variants thereof that retain functionality. In one embodiment the T cell activating bispecific antigen binding molecule comprises the polypeptide sequence of SEQ ID NO: 5, the polypeptide sequence of SEQ ID NO: 23, the polypeptide sequence of SEQ ID NO: 215 and the polypeptide sequence of SEQ ID NO: 217, or variants thereof that retain functionality. In one embodiment the T cell activating bispecific antigen binding molecule comprises the polypeptide sequence of SEQ ID NO: 5, the polypeptide sequence of SEQ ID NO: 23, the polypeptide sequence of SEQ ID NO: 215 and the polypeptide sequence of SEQ NO: 219, or variants thereof that retain functionality.

In one embodiment, the antigen binding moiety that is specific for MCSP comprises at least one heavy chain complementarity determining region (CDR) selected from the group consisting of SEQ ID NO: 280, SEQ ID NO: 281, SEQ ID NO: 282, SEQ ID NO: 301, SEQ ID NO: 303, SEQ ID NO: 304 and SEQ ID NO: 306 and at least one light chain CDR selected from the group of SEQ ID NO: 284, SEQ ID NO: 285, SEQ ID NO: 286, SEQ ID NO: 310, SEQ ID NO: 311, SEQ ID NO: 314, SEQ ID NO: 315, and SEQ ID NO: 316.

In one embodiment, the antigen binding moiety that is specific for MCSP comprises at least one heavy chain complementarity determining region (CDR) selected from the group consisting of SEQ ID NO: 280, SEQ ID NO: 281 and SEQ ID NO: 282 and at least one light chain CDR selected from the group of SEQ ID NO: 284, SEQ ID NO: 285 and SEQ ID NO: 286.

In one embodiment, the antigen binding moiety that is specific for MCSP comprises the heavy chain CDR1 of SEQ ID NO: 280 the heavy chain CDR2 of SEQ ID NO: 281 the heavy chain CDR3 of SEQ ID NO: 282 the light chain CDR1 of SEQ ID NO: 284, the light chain CDR2 of SEQ ID NO: 285, and the light chain CDR3 of SEQ ID NO: 286.

In a further embodiment, the antigen binding moiety that is specific for MCSP comprises a variable heavy chain comprising an amino acid sequence selected from the group of SEQ ID NO: 279, SEQ ID NO: 300, SEQ ID NO: 302, SEQ ID NO: 305 and SEQ ID NO: 307 and a variable light chain comprising an amino acid sequence selected from the group of SEQ ID NO: 283, SEQ ID NO: 309, SEQ ID NO: 312, SEQ ID NO: 313 and SEQ ID NO: 317.

In one embodiment, the antigen binding moiety that is specific for MCSP comprises a variable heavy chain comprising an amino acid sequence of SEQ ID NO: 279 and a variable light chain comprising an amino acid sequence of SEQ ID NO: 283.

In a further embodiment, the antigen binding moiety that is specific for MCSP comprises a heavy chain variable region sequence that is at least about 95%, 96%, 97%, 98%, 99% or 100% identical to SEQ ID NO: 279 and a light chain variable region sequence that is at least about 95%, 96%, 97%, 98%, 99% or 100% identical to SEQ ID NO: 283 or variants thereof that retain functionality.

In one embodiment the T cell activating bispecific antigen binding molecule comprises a polypeptide sequence that is at least about 95%, 96%, 97%, 98%, 99% or 100% identical to SEQ ID NO: 278, a polypeptide sequence that is at least about 95%, 96%, 97%, 98%, 99% or 100% identical to SEQ ID NO: 319, a polypeptide sequence that is at least about 95%, 96%, 97%, 98%, 99% or 100% identical to SEQ ID NO: 320, and a polypeptide sequence that is at least about 95%, 96%, 97%, 98%, 99% or 100% identical to SEQ ID NO: 321.

In one embodiment the T cell activating bispecific antigen binding molecule comprises a polypeptide sequence that is at least about 95%, 96%, 97%, 98%, 99% or 100% identical to SEQ NO: 369, a polypeptide sequence that is at least about 95%, 96%, 97%, 98%, 99% or 100% identical to SEQ ID NO: 370, and a polypeptide sequence that is at least about 95%, 96%, 97%, 98%, 99% or 100% identical to SEQ ID NO: 371.

In one embodiment the T cell activating bispecific antigen binding molecule comprises a polypeptide sequence that is at least about 95%, 96%, 97%, 98%, 99% or 100% identical to SEQ ID NO: 372, a polypeptide sequence that is at least about 95%, 96%, 97%, 98%, 99% or 100% identical to SEQ ID NO: 373, a polypeptide sequence that is at least about 95%, 96%, 97%, 98%, 99% or 100% identical to SEQ ID NO: 374, and a polypeptide sequence that is at least about 95%, 96%, 97%, 98%, 99% or 100% identical to SEQ ID NO: 375.

In a specific embodiment the T cell activating bispecific antigen binding molecule comprises a polypeptide sequence encoded by a polynucleotide sequence that is at least about 80%, 85%, 90%, 95%, 96%, 97%, 98%, 99% or 100% identical to a sequence selected from the group of SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28, SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 200, SEQ ID NO: 202, SEQ ID NO: 216, SEQ ID NO: 218, SEQ ID NO: 220, and SEQ ID NOs 329 to 388.

In one embodiment the T cell activating bispecific antigen binding molecule comprises at least one antigen binding moiety that is specific for Epidermal Growth Factor Receptor (EGFR). In another embodiment the T cell activating bispecific antigen binding molecule comprises at least one, typically two or more antigen binding moieties that can compete with monoclonal antibody GA201 for binding to an epitope of EGFR. See PCT publication WO 2006/082515, incorporated herein by reference in its entirety. In one embodiment, the antigen binding moiety that is specific for EGFR comprises the heavy chain CDR1 of SEQ ID NO: 85, the heavy chain CDR2 of SEQ ID NO: 87, the heavy chain CDR3 of SEQ ID NO: 89, the light chain CDR1 of SEQ ID NO: 93, the light chain CDR2 of SEQ ID NO: 95, and the light chain CDR3 of SEQ ID NO: 97. In a further embodiment, the antigen binding moiety that is specific for EGFR comprises a heavy chain variable region sequence that is at least about 80%, 85%, 90%, 95%, 96%, 97%, 98%, 99% or 100% identical to SEQ ID NO: 91 and a light chain variable region sequence that is at least about 80%, 85%, 90%, 95%, 96%, 97%, 98%, 99% or 100% identical to SEQ ID NO: 99, or variants thereof that retain functionality.

In yet another embodiment the T cell activating bispecific antigen binding molecule comprises the polypeptide sequence of SEQ ID NO: 43, the polypeptide sequence of SEQ ID NO: 45 and the polypeptide sequence of SEQ ID NO: 47, or variants thereof that retain functionality. In a further embodiment the T cell activating bispecific antigen binding molecule comprises the polypeptide sequence of SEQ ID NO: 49, the polypeptide sequence of SEQ ID NO: 51 and the polypeptide sequence of SEQ ID NO: 11, or variants thereof that retain functionality. In yet another embodiment the T cell activating bispecific antigen binding molecule comprises the polypeptide sequence of SEQ ID NO: 53, the polypeptide sequence of SEQ ID NO: 45 and the polypeptide sequence of SEQ ID NO: 47, or variants thereof that retain functionality.

In a specific embodiment the T cell activating bispecific antigen binding molecule comprises a polypeptide sequence encoded by a polynucleotide sequence that is at least about 80%, 85%, 90%, 95%, 96%, 97%, 98%, 99% or 100% identical to a sequence selected from the group of SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 44, SEQ ID NO: 46, SEQ ID NO: 48, SEQ ID NO: 50, SEQ ID NO: 52, SEQ ID NO: 54 and SEQ ID NO: 12.

In one embodiment the T cell activating bispecific antigen binding molecule comprises at least one antigen binding moiety that is specific for Fibroblast Activation Protein (FAP). In another embodiment the T cell activating bispecific antigen binding molecule comprises at least one, typically two or more antigen binding moieties that can compete with monoclonal antibody 3F2 for binding to an epitope of FAP. See PCT publication WO 2012/020006, incorporated herein by reference in its entirety. In one embodiment, the antigen binding moiety that is specific for FAP comprises the heavy chain CDR1 of SEQ ID NO: 101, the heavy chain CDR2 of SEQ ID NO: 103, the heavy chain CDR3 of SEQ ID NO: 105, the light chain CDR1 of SEQ ID NO: 109, the light chain CDR2 of SEQ ID NO: 111, and the light chain CDR3 of SEQ ID NO: 113. In a further embodiment, the antigen binding moiety that is specific for FAP comprises a heavy chain variable region sequence that is at least about 80%, 85%, 90%, 95%, 96%, 97%, 98%, 99% or 100% identical to SEQ ID NO: 107 and a light chain variable region sequence that is at least about 80%, 85%, 90%, 95%, 96%, 97%, 98%, 99% or 100% identical to SEQ ID NO: 115, or variants thereof that retain functionality.

In yet another embodiment the T cell activating bispecific antigen binding molecule comprises the polypeptide sequence of SEQ ID NO: 55, the polypeptide sequence of SEQ ID NO: 51 and the polypeptide sequence of SEQ ID NO: 11, or variants thereof that retain functionality. In a further embodiment the T cell activating bispecific antigen binding molecule comprises the polypeptide sequence of SEQ ID NO: 57, the polypeptide sequence of SEQ ID NO: 59 and the polypeptide sequence of SEQ ID NO: 61, or variants thereof that retain functionality.

In a specific embodiment the T cell activating bispecific antigen binding molecule comprises a polypeptide sequence encoded by a polynucleotide sequence that is at least about 80%, 85%, 90%, 95%, 96%, 97%, 98%, 99% or 100% identical to a sequence selected from the group of SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 56, SEQ ID NO: 58, SEQ ID NO: 60, SEQ ID NO: 62, SEQ ID NO: 52 and SEQ ID NO: 12.

In particular embodiments the 'I' cell activating bispecific antigen binding molecule comprises at least one antigen binding moiety that is specific for Carcinoembryonic Antigen (CEA). In one embodiment the T cell activating bispecific antigen binding molecule comprises at least one, typically two or more antigen binding moieties that can compete with monoclonal antibody BW431/26 (described in European patent no, EP 160 897, and Bosslet et al., Int J Cancer 36, 75-84 (1985)) for binding to an epitope of CEA. In one embodiment the T cell activating bispecific antigen binding molecule comprises at least one, typically two or more antigen binding moieties that can compete with monoclonal antibody CH1A1A (see SEQ ID NOs 123 and 131) for binding to an epitope of CEA. See PCT patent publication number WO 2011/023787, incorporated herein by reference in its entirety. In one embodiment, the antigen binding moiety that is specific for CEA binds to the same epitope of CEA as monoclonal antibody CH1A1A. In one embodiment, the antigen binding moiety that is specific for CEA comprises the heavy chain CDR1 of SEQ ID NO: 117, the heavy chain CDR2 of SEQ ID NO: 119, the heavy chain CDR3 of SEQ ID NO: 121, the light chain CDR1 of SEQ ID NO: 125, the light chain CDR2 of SEQ ID NO: 127, and the light chain CDR3 of SEQ ID NO: 129. In a further embodiment, the antigen binding moiety that is specific for CEA comprises a heavy chain variable region sequence that is at least about 80%, 85%, 90%, 95%, 96%, 97%, 98%, 99% or 100%, particularly about 98%, 99% or 100%, identical to SEQ ID NO: 123 and a light chain variable region sequence that is at least about 80%, 85%, 90%, 95%, 96%, 97%, 98%, 99% or 100%, particularly about 98%, 99% or 100%, identical to SEQ ID NO: 131, or variants thereof that retain functionality. In one embodiment, the antigen binding moiety that is specific for CEA comprises the heavy and light chain variable region sequences of an affinity matured version of monoclonal antibody CH1A1A. In one embodiment, the antigen binding moiety that is specific for CEA comprises the heavy chain variable region sequence of SEQ ID NO: 123 with one, two, three, four, five, six or seven, particularly two, three, four or five, amino acid substitutions; and the light chain variable region sequence of SEQ ID NO: 131 with one, two, three, four, five, six or seven, particularly two, three, four or five, amino acid substitutions. Any amino acid residue within the variable region sequences may be substituted by a different amino acid, including amino acid residues within the CDR regions, provided that binding to CEA, particularly human CEA, is preserved. Preferred variants are those having a binding affinity for CEA at least equal (or stronger) to the binding affinity of the antigen binding moiety comprising the unsubstituted variable region sequences.

In one embodiment the T cell activating bispecific antigen binding molecule comprises the polypeptide sequence of SEQ ID NO: 63, the polypeptide sequence of SEQ ID NO: 65, the polypeptide sequence of SEQ ID NO: 67 and the polypeptide sequence of SEQ ID NO: 33, or variants thereof that retain functionality. In one embodiment the T cell activating bispecific antigen binding molecule comprises the polypeptide sequence of SEQ ID NO: 65, the polypeptide sequence of SEQ ID NO: 67, the polypeptide sequence of SEQ ID NO: 183 and the polypeptide sequence of SEQ ID NO: 197, or variants thereof that retain functionality. In one embodiment the T cell activating bispecific antigen binding molecule comprises the polypeptide sequence of SEQ ID NO: 183, the polypeptide sequence of SEQ ID NO: 203, the polypeptide sequence of SEQ ID NO: 205 and the polypeptide sequence of SEQ ID NO: 207, or variants thereof that retain functionality. In one embodiment the T cell activating bispecific antigen binding molecule comprises the polypeptide sequence of SEQ ID NO: 183, the polypeptide sequence of SEQ ID NO: 209, the polypeptide sequence of SEQ ID NO: 211 and the polypeptide sequence of SEQ ID NO: 213, or variants thereof that retain functionality.

In a specific embodiment the T cell activating bispecific antigen binding molecule comprises a polypeptide sequence encoded by a polynucleotide sequence that is at least about 80%, 85%, 90%, 95%, 96%, 97%, 98%, 99% or 100% identical to a sequence selected from the group of SEQ NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 64, SEQ ID NO: 66, SEQ ID NO: 68, SEQ ID NO: 34, SEQ ID NO: 184, SEQ ID NO: 198, SEQ ID NO: 204, SEQ ID NO: 206, SEQ NO: 208, SEQ ID NO: 210, SEQ ID NO: 212 and SEQ ID NO: 214.

In one embodiment, the antigen binding moiety that is specific for CEA comprises at least one heavy chain complementarity determining region (CDR) selected from the group consisting of SEQ ID NO: 290, SEQ ID NO: 291 and SEQ ID NO: 292 and at least one light chain CDR selected from the group of SEQ ID NO: 294, SEQ ID NO: 295 and SEQ ID NO: 296.

In one embodiment, the antigen binding moiety that is specific for CEA comprises the heavy chain CDR1 of SEQ ID NO: 290, the heavy chain CDR2 of SEQ ID NO: 291, the heavy chain CDR3 of SEQ ID NO: 292, the light chain CDR1 of SEQ ID NO: 294, the light chain CDR2 of SEQ ID NO: 295, and the light chain CDR3 of SEQ ID NO: 296.

In one embodiment, the antigen binding moiety that is specific for CEA comprises a variable heavy chain comprising an amino acid sequence of SEQ ID NO: 289 and a variable light chain comprising an amino acid sequence of SEQ ID NO: 293.

In a further embodiment, the antigen binding moiety that is specific for CEA comprises a heavy chain variable region sequence that is at least about 95%, 96%, 97%, 98%, 99% or 100% identical to SEQ ID NO: 289 and a light chain variable region sequence that is at least about 95%, 96%, 97%, 98%, 99% or 100% identical to SEQ ID NO: 293, or variants thereof that retain functionality.

In one embodiment the T cell activating bispecific antigen binding molecule comprises a polypeptide sequence that is at least about 95%, 96%, 97%, 98%, 99% or 100% identical to SEQ ID NO: 288, a polypeptide sequence that is at least about 95%, 96%, 97%, 98%, 99% or 100% identical to SEQ ID NO: 322, a polypeptide sequence that is at least about 95%, 96%, 97%, 98%, 99% or 100% identical to SEQ ID NO: 323, and a polypeptide sequence that is at least about 95%, 96%, 97%, 98%, 99% or 100% identical to SEQ ID NO: 324.

In one embodiment the T cell activating bispecific antigen binding molecule comprises at least one antigen binding moiety that is specific for CD33, In one embodiment, the antigen binding moiety that is specific for CD33 comprises the heavy chain CDR1 of SEQ ID NO: 133, the heavy chain CDR2 of SEQ ID NO: 135, the heavy chain CDR3 of SEQ ID NO: 137, the light chain CDR1 of SEQ ID NO: 141, the light chain CDR2 of SEQ ID NO: 143, and the light chain CDR3 of SEQ ID NO: 145. In a further embodiment, the antigen binding moiety that is specific for CD33 comprises a heavy chain variable region sequence that is at least about 80%, 85%, 90%, 95%, 96%, 97%, 98%, 99% or 100% identical to SEQ ID NO: 139 and a light chain variable region sequence that is at least about 80%, 85%, 90%, 95%, 96%, 97%, 98%, 99% or 100% identical to SEQ ID NO: 147, or variants thereof that retain functionality.

In one embodiment the T cell activating bispecific antigen binding molecule comprises the polypeptide sequence of SEQ ID NO: 33, the polypeptide sequence of SEQ ID NO: 213, the polypeptide sequence of SEQ ID NO: 221 and the polypeptide sequence of SEQ ID NO: 223, or variants thereof that retain functionality. In one embodiment the T cell activating bispecific antigen binding molecule comprises the polypeptide sequence of SEQ ID NO: 33, the polypeptide sequence of SEQ ID NO: 221, the polypeptide sequence of SEQ ID NO: 223 and the polypeptide sequence of SEQ ID NO: 225, or variants thereof that retain functionality.

In a specific embodiment the T cell activating bispecific antigen binding molecule comprises a polypeptide sequence encoded by a polynucleotide sequence that is at least about 80%, 85%, 90%, 95%©, 96%, 97%, 98%, 99% or 100% identical to a sequence selected from the group of SEQ ID NO: 134, SEQ ID NO: 136, SEQ ID NO: 138, SEQ ID NO: 140. SEQ ID NO: 142, SEQ ID NO: 144, SEQ ID NO: 146, SEQ ID NO: 148, SEQ ID NO: 34, SEQ ID NO: 214, SEQ ID NO: 222, SEQ ID NO: 224 and SEQ ID NO: 226.

Polynucleotides

The invention further provides isolated polynucleotides encoding a T cell activating bispecific antigen binding molecule as described herein or a fragment thereof.

Polynucleotides of the invention include those that are at least about 80%, 85%, 90%, 95%, 96%, 97%, 98%, 99%, or 100% identical to the sequences set forth in SEQ ID NOs 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 373, 374, 375, 376, 377, 378, 379, 380, 381, 382, 383, 384, 385, 386, 387 and 388 including functional fragments or variants thereof.

The polynucleotides encoding T cell activating bispecific antigen binding molecules of the invention may be expressed as a single polynucleotide that encodes the entire T cell activating bispecific antigen binding molecule or as multiple (e.g., two or more) polynucleotides that are co-expressed. Polypeptides encoded by polynucleotides that are co-expressed may associate through, e.g., disulfide bonds or other means to form a functional T cell activating bispecific antigen binding molecule. For example, the light chain portion of an antigen binding moiety may be encoded by a separate polynucleotide from the portion of the T cell activating bispecific antigen binding molecule comprising the heavy chain portion of the antigen binding moiety, an Fc domain subunit and optionally (part of) another antigen binding moiety. When co-expressed, the heavy chain polypeptides will associate with the light chain polypeptides to form the antigen binding moiety in another example, the portion of the T cell activating bispecific antigen binding molecule comprising one of the two Fc domain subunits and optionally (part of) one or more antigen binding moieties could be encoded by a separate polynucleotide from the portion of the T cell activating bispecific antigen binding molecule comprising the other of the two Fc domain subunits and optionally (part of) an antigen binding moiety. When co-expressed, the Fc domain subunits will associate to form the Fc domain.

In certain embodiments, an isolated polynucleotide of the invention encodes a fragment of a T cell activating bispecific antigen binding molecule comprising a first and a second antigen binding moiety, and an Fc domain consisting of two subunits, wherein the first antigen binding moiety is a single chain Fab molecule. In one embodiment, an isolated polynucleotide of the invention encodes the first antigen binding moiety and a subunit of the Fc domain. In a more specific embodiment the isolated polynucleotide encodes a polypeptide wherein a single chain Fab molecule shares a carboxy-terminal peptide bond with an Fc domain subunit. In another embodiment, an isolated polynucleotide of the invention encodes the heavy chain of the second antigen binding moiety and a subunit of the Fc domain. In a more specific embodiment the isolated polynucleotide encodes a polypeptide wherein a Fab heavy chain shares a carboxy terminal peptide bond with an Fc domain subunit. In yet another embodiment, an isolated polynucleotide of the invention encodes the first antigen binding moiety, the heavy chain of the second antigen binding moiety and a subunit of the Fc domain. In a more specific embodiment, the isolated polynucleotide encodes a polypeptide wherein a single chain Fab molecule shares a carboxy-terminal peptide bond with a Fab heavy chain, which in turn shares a carboxy-terminal peptide bond with an Fc domain subunit.

In certain embodiments, an isolated polynucleotide of the invention encodes a fragment of a T cell activating bispecific antigen binding molecule comprising a first and a second antigen binding moiety, and an Fc domain consisting of two subunits, wherein the first antigen binding moiety is a crossover Fab molecule. In one embodiment, an isolated polynucleotide of the invention encodes the heavy chain of the first antigen binding moiety and a subunit of the Fc domain. In a more specific embodiment the isolated polynucleotide encodes a polypeptide wherein Fab light chain variable region shares a carboxy terminal peptide bond with a Fab heavy chain constant region, which in turn shares a carboxy-terminal peptide bond with an Fc domain subunit. In another specific embodiment the isolated polynucleotide encodes a polypeptide wherein Fab heavy chain variable region shares a carboxy terminal peptide bond with a Fab light chain constant region, which in turn shares a carboxy-terminal peptide bond with an Fc domain subunit. In another embodiment, an isolated polynucleotide of the invention encodes the heavy chain of the second antigen binding moiety and a subunit of the Fc domain. In a more specific embodiment the isolated polynucleotide encodes a polypeptide wherein a Fab heavy chain shares a carboxy terminal peptide bond with an Fc domain subunit. In yet another embodiment, an isolated polynucleotide of the invention encodes the heavy chain of the first antigen binding moiety, the heavy chain of the second antigen binding moiety and a subunit of the Fc domain. In a more specific embodiment, the isolated polynucleotide encodes a polypeptide wherein a Fab light chain variable region shares a carboxy-terminal peptide bond with a Fab heavy chain constant region, which in turn shares a carboxy-terminal peptide bond with a Fab heavy chain, which in turn shares a carboxy-terminal peptide bond with an Fc domain subunit. In another specific embodiment, the isolated polynucleotide encodes a polypeptide wherein a Fab heavy chain variable region shares a carboxy-terminal peptide bond with a Fab light chain constant region, which in turn shares a carboxy-terminal peptide bond with a Fab heavy chain, which in turn shares a carboxy-terminal peptide bond with an Fc domain subunit. In yet another specific embodiment the isolated polynucleotide encodes a polypeptide wherein a Fab heavy chain shares a carboxy-terminal peptide bond with a Fab light chain variable region, which in turn shares a carboxy-terminal peptide bond with a Fab heavy chain constant region, which in turn shares a carboxy-terminal peptide bond with an Pc domain subunit. In still another specific embodiment the isolated polynucleotide encodes a polypeptide wherein a Fab heavy chain shares a carboxy-terminal peptide bond with a Fab heavy chain variable region, which in turn shares a carboxy-terminal peptide bond with a Fab light chain constant region, which in turn shares a carboxy-terminal peptide bond with an Pc domain subunit.

In further embodiments, an isolated polynucleotide of the invention encodes the heavy chain of a third antigen binding moiety and a subunit of the Fc domain. In a more specific embodiment the isolated polynucleotide encodes a polypeptide wherein a Fab heavy chain shares a carboxy terminal peptide bond with an Fc domain subunit.

In further embodiments, an isolated polynucleotide of the invention encodes the light chain of an antigen binding moiety. In some embodiments, the isolated polynucleotide encodes a polypeptide wherein a Fab light chain variable region shares a carboxy-terminal peptide bond with a Fab heavy chain constant region. In other embodiments, the isolated polynucleotide encodes a polypeptide wherein a Fab heavy chain variable region shares a carboxy-terminal peptide bond with a Fab light chain constant region. In still other embodiments, an isolated polynucleotide of the invention encodes the light chain of the first antigen binding moiety and the light chain of the second antigen binding moiety. In a more specific embodiment, the isolated polynucleotide encodes a polypeptide wherein a Fab heavy chain variable region shares a carboxy-terminal peptide bond with a Fab light chain constant region, which in turn shares a carboxy-terminal peptide bond with a Fab light chain. In another specific embodiment the isolated polynucleotide encodes a polypeptide wherein a Fab light chain shares a carboxy-terminal peptide bond with a Fab heavy chain variable region, which in turn shares a carboxy-terminal peptide bond with a Fab light chain constant region. In yet another specific embodiment, the isolated polynucleotide encodes a polypeptide wherein a Fab light chain variable region shares a carboxy-terminal peptide bond with a Fab heavy chain constant region, which in turn shares a carboxy-terminal peptide bond with a Fab light chain. In yet another specific embodiment the isolated polynucleotide encodes a polypeptide wherein a Fab light chain shares a carboxy-terminal peptide bond with a Fab light chain variable region, which in turn shares a carboxy-terminal peptide bond with a Fab heavy chain constant region.

In another embodiment, the present invention is directed to an isolated polynucleotide encoding a T cell activating bispecific antigen binding molecule of the invention or a fragment thereof, wherein the polynucleotide comprises a sequence that encodes a variable region sequence as shown in SEQ ID NOs 75, 83, 91, 99, 107, 115, 123, 131, 139, 147, 169, 177, 239, 247, 255 and 263. In another embodiment, the present invention is directed to an isolated polynucleotide encoding a T cell activating bispecific antigen binding molecule or fragment thereof, wherein the polynucleotide comprises a sequence that encodes a polypeptide sequence as shown in SEQ ID NOs 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 179, 181, 183, 185, 187, 189, 191, 193, 195, 197, 199, 201, 203, 205, 207, 209, 211, 213, 215, 217, 219, 221, 223, 225, 227, 229, 231, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327 and 328. In another embodiment, the invention is further directed to an isolated polynucleotide encoding a T cell activating bispecific antigen binding molecule of the invention or a fragment thereof, wherein the polynucleotide comprises a sequence that is at least about 80%, 85%, 90%, 95%, 96%, 97%, 98%, or 99% identical to a nucleotide sequence shown in SEQ ID NOs 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 373, 374, 375, 376, 377, 378, 379, 380, 381, 382, 383, 384, 385, 386, 387 or 388. In another embodiment, the invention is directed to an isolated polynucleotide encoding a T cell activating bispecific antigen binding molecule of the invention or a fragment thereof, wherein the polynucleotide comprises a nucleic acid sequence shown in SEQ ID NOs 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 373, 374, 375, 376, 377, 378, 379, 380, 381, 382, 383, 384, 385, 386, 387 or 388. In another embodiment, the invention is directed to an isolated polynucleotide encoding a T cell activating bispecific antigen binding molecule of the invention or a fragment thereof, wherein the polynucleotide comprises a sequence that encodes a variable region sequence that is at least about 80%, 85%, 90%, 95%, 96%, 97%, 98%, or 99% identical to an amino acid sequence in SEQ ID NOs 75, 83, 91, 99, 107, 115, 123, 131, 139, 147, 169, 177, 239, 247, 255 or 263. In another embodiment, the invention is directed to an isolated polynucleotide encoding a T cell activating bispecific antigen binding molecule or fragment thereof, wherein the polynucleotide comprises a sequence that encodes a polypeptide sequence that is at least 80%, 85%, 90%, 95%, 96%, 97%, 98%, or 99% identical to an amino acid sequence in SEQ ID NOs 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 179, 181, 183, 185, 187, 189, 191, 193, 195, 197, 199, 201, 203, 205, 207, 209, 211, 213, 215, 217, 219, 221, 223, 225, 227, 229, 231, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327 or 328. The invention encompasses an isolated polynucleotide encoding a T cell activating bispecific antigen binding molecule of the invention or a fragment thereof, wherein the polynucleotide comprises a sequence that encodes the variable region sequence of SEQ ID NOs 75, 83, 91, 99, 107, 115, 123, 131, 139, 147, 169, 177, 239, 247, 255 or 263 with conservative amino acid substitutions. The invention also encompasses an isolated polynucleotide encoding a T cell activating bispecific antigen binding molecule of the invention or fragment thereof, wherein the polynucleotide comprises a sequence that encodes the polypeptide sequence of SEQ ID NOs 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 179, 181, 183, 185, 187, 189, 191, 193, 195, 197, 199, 201, 203, 205, 207, 209, 211, 213, 215, 217, 219, 221, 223, 225, 227, 229, 231, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327 or 328, with conservative amino acid substitutions.

In certain embodiments the polynucleotide or nucleic acid is DNA. In other embodiments, a polynucleotide of the present invention is RNA, for example, in the form of messenger RNA (mRNA). RNA of the present invention may be single stranded or double stranded.

Recombinant Methods

T cell activating bispecific antigen binding molecules of the invention may be obtained, for example, by solid-state peptide synthesis (e.g. Merrifield solid phase synthesis) or recombinant production. For recombinant production one or more polynucleotide encoding the T cell activating bispecific antigen binding molecule (fragment), e.g., as described above, is isolated and inserted into one or more vectors for further cloning and/or expression in a host cell. Such polynucleotide may be readily isolated and sequenced using conventional procedures. In one embodiment a vector, preferably an expression vector, comprising one or more of the polynucleotides of the invention is provided. Methods which are well known to those skilled in the art can be used to construct expression vectors containing the coding sequence of a T cell activating bispecific antigen binding molecule (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989); and Ausubel et al., CURRENT PROTOCOLS IN MOLECULAR BIOLOGY, Greene Publishing Associates and Wiley Interscience, N.Y. (1989). The expression vector can be part of a plasmid, virus, or may be a nucleic acid fragment. The expression vector includes an expression cassette into which the polynucleotide encoding the T cell activating bispecific antigen binding molecule (fragment) (i.e. the coding region) is cloned in operable association with a promoter and/or other transcription or translation control elements. As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the T cell activating bispecific antigen binding molecule (fragment) of the invention, or variant or derivative thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription. Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit â-globin, as well as other sequences capable of controlling gene expression in eukaryotic cells. Additional suitable transcription control regions include tissue-specific promoters and enhancers as well as inducible promoters (e.g. promoters inducible tetracyclins). Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the T cell activating bispecific antigen binding molecule is desired, DNA encoding a signal sequence may be placed upstream of the nucleic acid encoding a T cell activating bispecific antigen binding molecule of the invention or a fragment thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase. Exemplary amino acid and polynucleotide sequences of secretory signal peptides are given in SEQ ID NOs 154-162.

DNA encoding a short protein sequence that could be used to facilitate later purification (e.g. a histidine tag) or assist in labeling the T cell activating bispecific antigen binding molecule may be included within or at the ends of the T cell activating bispecific antigen binding molecule (fragment) encoding polynucleotide.

In a further embodiment, a host cell comprising one or more polynucleotides of the invention is provided. In certain embodiments a host cell comprising one or more vectors of the invention is provided. The polynucleotides and vectors may incorporate any of the features, singly or in combination, described herein in relation to polynucleotides and vectors, respectively. In one such embodiment a host cell comprises (e.g. has been transformed or transfected with a vector comprising a polynucleotide that encodes (part of) a T cell activating bispecific antigen binding molecule of the invention. As used herein, the term "host cell" refers to any kind of cellular system which can be engineered to generate the T cell activating bispecific antigen binding molecules of the invention or fragments thereof. Host cells suitable for replicating and for supporting expression of T cell activating bispecific antigen binding molecules are well known in the art. Such cells may be transfected or transduced as appropriate with the particular expression vector and large quantities of vector containing cells can be grown for seeding large scale fermenters to obtain sufficient quantities of the T cell activating bispecific antigen binding molecule for clinical applications.

Suitable host cells include prokaryotic microorganisms, such as E. coli, or various eukaryotic cells, such as Chinese hamster ovary cells (CM), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross, Nat Biotech 1409-1414 (2004), and Li et al., Nat Biotech 24, 210-215 (2006). Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of Spodoptera frugiperda cells. Plant cell cultures can also be utilized as hosts. See e.g. U.S. Pat. Nos. 5,959,177, 6,040,498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather, Biol Reprod. 23, 243-251 (1980)), monkey kidney cells (CV1), African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)), MRC 5 cells, and FS4 cells. Other useful mammalian host cell lines include Chinese hamster ovary (CHO) cells, including dhfr⁻ CHO cells (Urlaub et al., Proc Natl Acad Sci USA 77, 4216 (1980)); and myeloma cell lines such as YO, NS0, P3X63 and Sp2/0. For a review of certain mammalian host cell lines suitable for protein production, see, e.g., Yazaki and Wu, Methods in Molecular Biology, Vol. 248 (B. K. C. Lo, ed., Humana Press, Totowa, N.J.), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., Y0, NS0, Sp20 cell).

Standard technologies are known in the art to express foreign genes in these systems. Cells expressing a polypeptide comprising either the heavy or the light chain of an antigen binding domain such as an antibody, may be engineered so as to also express the other of the antibody chains such that the expressed product is an antibody that has both a heavy and a light chain.

In one embodiment, a method of producing a T cell activating bispecific antigen binding molecule according to the invention is provided, wherein the method comprises culturing a host cell comprising a polynucleotide encoding the T cell activating bispecific antigen binding molecule, as provided herein, under conditions suitable for expression of the T cell activating bispecific antigen binding molecule, and recovering the T cell activating bispecific antigen binding molecule from the host cell (or host cell culture medium).

The components of the T cell activating bispecific antigen binding molecule are genetically fused to each other, cell activating bispecific antigen binding molecule can be designed such that its components are fused directly to each other or indirectly through a linker sequence. The composition and length of the linker may be determined in accordance with methods well known in the art and may be tested for efficacy. Examples of linker sequences between different components of T cell activating bispecific antigen binding molecules are found in the sequences provided herein. Additional sequences may also be included to incorporate a cleavage site to separate the individual components of the fusion if desired, for example an endopeptidase recognition sequence.

In certain embodiments the one or more antigen binding moieties of the T cell activating bispecific antigen binding molecules comprise at least an antibody variable region capable of binding an antigenic determinant. Variable regions can form part of and be derived from naturally or non-naturally occurring antibodies and fragments thereof. Methods to produce polyclonal antibodies and monoclonal antibodies are well known in the art (see e.g. Harlow and Lane, "Antibodies, a laboratory manual", Cold Spring Harbor Laboratory, 1988). Non-naturally occurring antibodies can be constructed using solid phase-peptide synthesis, can be produced recombinantly (e.g. as described in U.S. Pat. No. 4,186,567) or can be obtained, for example, by screening combinatorial libraries comprising variable heavy chains and variable light chains (see e.g. U.S. Pat. No. 5,969,108 to McCafferty).

Any animal species of antibody, antibody fragment, antigen binding domain or variable region can be used in the cell activating bispecific antigen binding molecules of the invention. Non-limiting antibodies, antibody fragments, antigen binding domains or variable regions useful in the present invention can be of murine, primate, or human origin. If the T cell activating bispecific antigen binding molecule is intended for human use, a chimeric form of antibody may be used wherein the constant regions of the antibody are from a human. A humanized or fully human form of the antibody can also be prepared in accordance with methods well known in the art (see e. g. U.S. Pat. No. 5,565,332 to Winter). Humanization may be achieved by various methods including, but not limited to (a) grafting the non-human (e.g., donor antibody) CDRs onto human (e.g. recipient antibody) framework and constant regions with or without retention of critical framework residues (e.g. those that are important for retaining good antigen binding affinity or antibody functions), (b) grafting only the non-human specificity-determining regions (SDRs or a-CDRs; the residues critical for the antibody-antigen interaction) onto human framework and constant regions, or (c) transplanting the entire non-human variable domains, but "cloaking" them with a human-like section by replacement of surface residues. Humanized antibodies and methods of making them are reviewed, e.g., in Almagro and Fransson, Front Biosci 13, 1619-1633 (2008), and are further described, e.g., in Riechmann et al., Nature 332, 323-329 (1988); Queen et al., Proc Natl Acad Sci USA 86, 10029-10033 (1989); U.S. Pat. Nos. 5,821,337, 7,527,791, 6,982,321, and 7,087,409; Jones et al., Nature 321, 522-525 (1986); Morrison et al., Proc Natl Acad Sci 81, 6851-6855 (1984); Morrison and Oi, Adv Immunol 44, 65-92 (1988); Verhoeyen et al., Science 239, 1534-1536 (1988); Padlan, Molec Immun 31(3), 169-217 (1994); Kashmiri et al., Methods 36, 25-34 (2005) (describing SDR (a-CDR) grafting); Padlan, Mol Immunol 28, 489-498 (1991) (describing "resurfacing"); Dall'Acqua et al., Methods 36, 43-60 (2005) (describing "FR shuffling"); and Osbourn et al., Methods 36, 61-68 (2005) and Klimka et al., Br J Cancer 83, 252-260 (2000) (describing the "guided selection" approach to FR shuffling). Human antibodies and human variable regions can be produced using various techniques known in the art. Human antibodies are described generally in van Dijk and van de Winkel, Curr Opin Pharmacol 5, 368-74 (2001) and Lonberg, Curr Opin Immunol 20, 450-459 (2008). Human variable regions can form part of and be derived from human monoclonal antibodies made by the hybridoma method (see e.g. Monoclonal Antibody Production Techniques and Applications, pp. 51-63 (Marcel Dekker, Inc., New York, 1987)). Human antibodies and human variable regions may also be prepared by administering an immunogen to a transgenic animal that has been modified to produce intact human antibodies or intact antibodies with human variable regions in response to antigenic challenge (see e.g. Lonberg, Nat Biotech 23, 1117-1125 (2005). Human antibodies and human variable regions may also be generated by isolating Fv clone variable region sequences selected from human-derived phage display libraries (see e.g., Hoogenboom et al. in Methods in Molecular Biology 178, 1-37 (O'Brien et al., ed., Human Press, Totowa, N.J., 2001); and McCafferty et al., Nature 348, 552-554; Clackson et al., Nature 352, 624-628 (1991)). Phage typically display antibody fragments, either as single-chain Fv (scFv) fragments or as Fab fragments.

In certain embodiments, the antigen binding moieties useful in the present invention are engineered to have enhanced binding affinity according to, for example, the methods disclosed in U.S. Pat. Appl. Publ. No. 2004/0132066, the entire contents of which are hereby incorporated by reference. The ability of the T cell activating bispecific antigen binding molecule of the invention to bind to a specific antigenic determinant can be measured either through an enzyme-linked immunosorbent assay (ELISA) or other techniques familiar to one of skill in the an, e.g. surface plasmon resonance technique (analyzed on a BIACORE T100 system) (Liljeblad, et al., Glyco J 17, 323-329 (2000)), and traditional binding assays (Heeley, Endocr Res 28, 217-229 (2002)). Competition assays may be used to identify an antibody, antibody fragment, antigen binding domain or variable domain that competes with a reference antibody for binding to a particular antigen, e.g. an antibody that competes with the V9 antibody for binding to CD3. In certain embodiments, such a competing antibody binds to the same epitope (e.g. a linear or a conformational epitope) that is bound by the reference antibody. Detailed exemplary methods for mapping an epitope to which an antibody binds are provided in Morris (1996) "Epitope Mapping Protocols," in Methods in Molecular Biology vol. 66 (Humana Press, Totowa, N.J.). In an exemplary competition assay, immobilized antigen (e.g. CD3) is incubated in a solution comprising a first labeled antibody that binds to the antigen (e.g. V9 antibody) and a second unlabeled antibody that is being tested for its ability to compete with the first antibody for binding to the antigen. The second antibody may be present in a hybridoma supernatant. As a control, immobilized antigen is incubated in a solution comprising the first labeled antibody but not the second unlabeled antibody. After incubation under conditions permissive for binding of the first antibody to the antigen, excess unbound antibody is removed, and the amount of label associated with immobilized antigen is measured. If the amount of label associated with immobilized antigen is substantially reduced in the test sample relative to the control sample, then that indicates that the second antibody is competing with the first antibody for binding to the antigen. See Harlow and Lane (1988) Antibodies: A Laboratory Manual ch. 14 (Cold Spring Harbor Laboratory, Cold Spring Harbor, N.Y.).

T cell activating bispecific antigen binding molecules prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the T cell activating bispecific antigen binding molecule binds. For example, for affinity chromatography purification of T cell activating bispecific antigen binding molecules of the invention, a matrix with protein A or protein G may be used, Sequential Protein A or G affinity chromatography and size exclusion chromatography can be used to isolate a T cell activating bispecific antigen binding molecule essentially as described in the Examples. The purity of the T cell activating bispecific antigen binding molecule can be determined by any of a variety of well known analytical methods including gel electrophoresis, high pressure liquid chromatography, and the like. For example, the heavy chain fusion proteins expressed as described in the Examples were shown to be intact and properly assembled as demonstrated by reducing SDS-PAGE (see e.g. FIG. 2). Three bands were resolved at approximately Mr 25,000, Mr 50,000 and Mr 75,000, corresponding to the predicted molecular weights of the T cell activating bispecific antigen binding molecule light chain, heavy chain and heavy chain/light chain fusion protein.

Assays

T cell activating bispecific antigen binding molecules provided herein may be identified, screened for, or characterized for their physical/chemical properties and/or biological activities by various assays known in the art.

Affinity Assays

The affinity of the cell activating bispecific antigen binding molecule for an Fc receptor or a target antigen can be determined in accordance with the methods set forth in the Examples by surface plasmon resonance (SPR), using standard instrumentation such as a BIAcore instrument (GE Healthcare), and receptors or target proteins such as may be obtained by recombinant expression. Alternatively, binding of T cell activating bispecific antigen binding molecules for different receptors or target antigens may be evaluated using cell lines expressing the particular receptor or target antigen, for example by flow cytometry (FACS). A specific illustrative and exemplary embodiment for measuring binding affinity is described in the following and in the Examples below. According to one embodiment, $K_D$ is measured by surface plasmon resonance using a BIACORE® T100 machine (GE Healthcare) at 25° C.

To analyze the interaction between the Fc-portion and receptors, His-tagged recombinant Fc-receptor is captured by an anti-Penta His antibody (Qiagen) immobilized on CM5 chips and the bispecific constructs are used as analytes. Briefly, carboxymethylated dextran biosensor chips (CM5, GE Healthcare) are activated with N-ethyl-N'-(3-dimethylaminopropyl)-carbodiimide hydrochloride (EDC) and N-hydroxysuccinimide (NHS) according to the supplier's instructions. Anti Penta-His antibody is diluted with 10 mM sodium acetate, pH 5.0, to 40 μg/ml before injection at a flow rate of 5 μl/min to achieve approximately 6500 response units (RU) of coupled protein. Following the injection of the ligand, 1 M ethanolamine is injected to block unreacted groups. Subsequently the Fc-receptor is captured for 60 s at 4 or 10 nM. For kinetic measurements, four-fold serial dilutions of the bispecific construct (range between 500 nM and 4000 nM) are injected in HBS-EP (GE Healthcare, 10 mM HEPES, 150 mM NaCl, 3 mM EDTA, 0.05% Surfactant P20, pH 7.4) at 25° C. at a flow rate of 30 μl/min for 120 s.

To determine the affinity to the target antigen, bispecific constructs are captured by an anti human Fab specific antibody (GE Healthcare) that is immobilized on an activated CM5-sensor chip surface as described for the anti Penta-His antibody. The final amount of coupled protein is approximately 12000 RU. The bispecific constructs are captured for 90 s at 300 nM. The target antigens are passed through the flow cells for 180 s at a concentration range from 250 to 1000 nM with a flowrate of 30 μl/min. The dissociation is monitored for 180 s.

Bulk refractive index differences are corrected for by subtracting the response obtained on reference flow cell. The steady state response was used to derive the dissociation constant $K_D$ by non-linear curve fitting of the Langmuir binding isotherm. Association rates ($k_{on}$) and dissociation rates ($k_{off}$) are calculated using a simple one-to-one Langmuir binding model (BIACORE® T100 Evaluation Software version 1.1.1) by simultaneously fitting the association and dissociation sensorgrams. The equilibrium dissociation constant ($K_D$) is calculated as the ratio $k_{off}/k_{on}$. See, e.g., Chen et al., J Mol Biol 293, 865-881 (1999).

Activity Assays

Biological activity of the T cell activating bispecific antigen binding molecules of the invention can be measured by various assays as described in the Examples. Biological activities may for example include the induction of proliferation of T cells, the induction of signaling in T cells, the induction of expression of activation markers in T cells, the induction of cytokine secretion by T cells, the induction of lysis of target cells such as tumor cells, and the induction of tumor regression and/or the improvement of survival.

Compositions, Formulations, and Routes of Administration

In a further aspect, the invention provides pharmaceutical compositions comprising any of the T cell activating bispecific antigen binding molecules provided herein, e.g., for use in any of the below therapeutic methods. In one embodiment, a pharmaceutical composition comprises any of the T cell activating bispecific antigen binding molecules provided herein and a pharmaceutically acceptable carrier. In another embodiment, a pharmaceutical composition comprises any of the T cell activating bispecific antigen binding molecules provided herein and at least one additional therapeutic agent, e.g., as described below.

Further provided is a method of producing a T cell activating bispecific antigen binding molecule of the invention in a form suitable for administration in vivo, the method comprising (a) obtaining a T cell activating bispecific antigen binding molecule according to the invention, and (b) formulating the T cell activating bispecific antigen binding molecule with at least one pharmaceutically acceptable carrier, whereby a preparation of T cell activating bispecific antigen binding molecule is formulated for administration in vivo.

Pharmaceutical compositions of the present invention comprise a therapeutically effective amount of one or more T cell activating bispecific antigen binding molecule dissolved or dispersed in a pharmaceutically acceptable carrier. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one cell activating bispecific antigen binding molecule and optionally an additional active ingredient will be known to those of skill in the art in light of the present disclosure, as exemplified by Remington's Pharmaceutical Sciences, 18th Ed, Mack Printing Company, 1990, incorporated herein by reference. Moreover, for animal (e.g., human) administration, it will be understood that preparations should meet sterility, pyrogenicity, general safety and purity standards as required by FDA Office of Biological Standards or corresponding authorities in other countries. Preferred compositions are lyophilized formulations or aqueous solutions. As used herein, "pharmaceutically acceptable carrier" includes any and all solvents, buffers, dispersion media, coatings, surfactants, antioxidants, preservatives (e.g. antibacterial agents, antifungal agents), isotonic agents, absorption delaying agents, salts, preservatives, antioxidants, proteins, drugs, drug stabilizers, polymers, gels, binders, excipients, disintegration agents, lubricants, sweetening agents, flavoring agents, dyes, such like materials and combinations thereof, as would be known to one of ordinary skill in the art (see, for example, Remington's Pharmaceutical Sciences, 18th Ed. Mack Printing Company, 1990, pp. 1289-1329, incorporated herein by reference). Except insofar as any conventional carrier is incompatible with the active ingredient, its use in the therapeutic or pharmaceutical compositions is contemplated.

The composition may comprise different types of carriers depending on whether it is to be administered in solid, liquid or aerosol form, and whether it need to be sterile for such routes of administration as injection. T cell activating bispecific antigen binding molecules of the present invention (and any additional therapeutic agent) can be administered intravenously, intradermally, intraarterially, intraperitoneally, intralesionally, intracranially, intraarticularly, intraprostatically, intrasplenically, intrarenally, intrapleurally, intratracheally, intranasally, intravitreally, intravaginally, intrarectally, intratumorally, intramuscularly, intraperitoneally, subcutaneously, subconjunctivally, intravesicularlly, mucosally, intrapericardially, intraumbilically, intraocularally, orally, topically, locally, by inhalation (e.g. aerosol inhalation), injection, infusion, continuous infusion, localized perfusion bathing target cells directly, via a catheter, via a lavage, in cremes, in lipid compositions (e.g. liposomes), or by other method or any combination of the forgoing as would be known to one of ordinary skill in the art (see, for example, Remington's Pharmaceutical Sciences, 18th Ed. Mack Printing Company, 1990, incorporated herein by reference). Parenteral administration, in particular intravenous injection, is most commonly used for administering polypeptide molecules such as the T cell activating bispecific antigen binding molecules of the invention.

Parenteral compositions include those designed for administration by injection, e.g. subcutaneous, intradermal, intralesional, intravenous, intraarterial intramuscular, intrathecal or intraperitoneal injection. For injection, the T cell activating bispecific antigen binding molecules of the invention may be formulated in aqueous solutions, preferably in physiologically compatible buffers such as Hanks' solution, Ringer's solution, or physiological saline buffer. The solution may contain formulatory agents such as suspending, stabilizing and/or dispersing agents. Alternatively, the T cell activating bispecific antigen binding molecules may be in powder form for constitution with a suitable vehicle, e.g., sterile pyrogen-free water, before use. Sterile injectable solutions are prepared by incorporating the T cell activating bispecific antigen binding molecules of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less that 0.5 ng/mg protein. Suitable pharmaceutically acceptable carriers include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company, 1990). Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof.

In addition to the compositions described previously, the T cell activating bispecific antigen binding molecules may also be formulated as a depot preparation. Such long acting formulations may be administered by implantation (for example subcutaneously or intramuscularly) or by intramuscular injection. Thus, for example, the T cell activating bispecific antigen binding molecules may be formulated with suitable polymeric or hydrophobic materials (for example as an emulsion in an acceptable oil) or ion exchange resins, or as sparingly soluble derivatives, for example, as a sparingly soluble salt.

Pharmaceutical compositions comprising the T cell activating bispecific antigen binding molecules of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen.

The T cell activating bispecific antigen binding molecules may be formulated into a composition in a free acid or base, neutral or salt form. Pharmaceutically acceptable salts are salts that substantially retain the biological activity of the free acid or base. These include the acid addition salts, e.g., those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other erotic solvents than are the corresponding free base forms.

Therapeutic Methods and Compositions

Any of the T cell activating bispecific antigen binding molecules provided herein may be used in therapeutic methods. T cell activating bispecific antigen binding molecules of the invention can be used as immunotherapeutic agents, for example in the treatment of cancers.

For use in therapeutic methods, T cell activating bispecific antigen binding molecules of the invention would be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

In one aspect, T cell activating bispecific antigen binding molecules of the invention for use as a medicament are provided. In further aspects, T cell activating bispecific antigen binding molecules of the invention for use in treating a disease are provided. In certain embodiments, T cell activating bispecific antigen binding molecules of the invention for use in a method of treatment are provided. In one embodiment, the invention provides a T cell activating bispecific antigen binding molecule as described herein for use in the treatment of a disease in an individual in need thereof. In certain embodiments, the invention provides a T cell activating bispecific antigen binding molecule for use in a method of treating an individual having a disease comprising administering to the individual a therapeutically effective amount of the T cell activating bispecific antigen binding molecule. In certain embodiments the disease to be treated is a proliferative disorder. In a particular embodiment the disease is cancer. In certain embodiments the method further comprises administering to the individual a therapeutically effective amount of at least one additional therapeutic agent, e.g., an anti-cancer agent if the disease to be treated is cancer. In further embodiments, the invention provides a T cell activating bispecific antigen binding molecule as described herein for use in inducing lysis of a target cell, particularly a tumor cell. In certain embodiments, the invention provides a T cell activating bispecific antigen binding molecule for use in a method of inducing lysis of a target cell, particularly a tumor cell, in an individual comprising administering to the individual an effective amount of the T cell activating bispecific antigen binding molecule to induce lysis of a target cell. An "individual" according to any of the above embodiments is a mammal, preferably a human.

In a further aspect, the invention provides for the use of a T cell activating bispecific antigen binding molecule of the invention in the manufacture or preparation of a medicament. In one embodiment the medicament is for the treatment of a disease in an individual in need thereof. In a further embodiment, the medicament is for use in a method of treating a disease comprising administering to an individual having the disease a therapeutically effective amount of the medicament. In certain embodiments the disease to be treated is a proliferative disorder. In a particular embodiment the disease is cancer. In one embodiment, the method further comprises administering to the individual a therapeutically effective amount of at least one additional therapeutic agent, e.g., an anti-cancer agent if the disease to be treated is cancer. In a further embodiment, the medicament is for inducing lysis of a target cell, particularly a tumor cell. In still a further embodiment, the medicament is for use in a method of inducing lysis of a target cell, particularly a tumor cell, in an individual comprising administering to the individual an effective amount of the medicament to induce lysis of a target cell, An "individual" according to any of the above embodiments may be a mammal, preferably a human.

In a further aspect, the invention provides a method for treating a disease. In one embodiment, the method comprises administering to an individual having such disease a therapeutically effective amount of a T cell activating bispecific antigen binding molecule of the invention. In one embodiment a composition is administered to said individual, comprising the T cell activating bispecific antigen binding molecule of the invention in a pharmaceutically acceptable form. In certain embodiments the disease to be treated is a proliferative disorder. In a particular embodiment the disease is cancer. In certain embodiments the method further comprises administering to the individual a therapeutically effective amount of at least one additional therapeutic agent, e.g., an anti-cancer agent if the disease to be treated is cancer. An "individual" according to any of the above embodiments may be a mammal, preferably a human.

In a further aspect, the invention provides a method for inducing lysis of a target cell, particularly a tumor cell. In one embodiment the method comprises contacting a target cell with a T cell activating bispecific antigen binding molecule of the invention in the presence of a T cell, particularly a cytotoxic T cell. In a further aspect, a method for inducing lysis of a target cell, particularly a tumor cell, in an individual is provided. In one such embodiment, the method comprises administering to the individual an effective amount of a T cell activating bispecific antigen binding molecule to induce lysis of a target cell. In one embodiment, an "individual" is a human.

In certain embodiments the disease to be treated is a proliferative disorder, particularly cancer. Non-limiting examples of cancers include bladder cancer, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer. Other cell proliferation disorders that can be treated using a T cell activating bispecific antigen binding molecule of the present invention include, but are not limited to neoplasms located in the abdomen, bone, breast, digestive system, liver, pancreas, peritoneum, endocrine glands (adrenal, parathyroid, pituitary, testicles, ovary, thymus, thyroid), eye, head and neck, nervous system (central and peripheral), lymphatic system, pelvic, skin, soft tissue, spleen, thoracic region, and urogenital system. Also included are pre-cancerous conditions or lesions and cancer metastases. In certain embodiments the cancer is chosen from the group consisting of renal cell cancer, skin cancer, lung cancer, colorectal cancer, breast cancer, brain cancer, head and neck cancer. A skilled artisan readily recognizes that in many cases the T cell activating bispecific antigen binding molecule may not provide a cure but may only provide partial benefit. In some embodiments, a physiological change having some benefit is also considered therapeutically beneficial. Thus, in some embodiments, an amount of T cell activating bispecific antigen binding molecule that provides a physiological change is considered an "effective amount" or a "therapeutically effective amount". The subject, patient, or individual in need of treatment is typically a mammal, more specifically a human.

In some embodiments, an effective amount of a T cell activating bispecific antigen binding molecule of the invention is administered to a cell. In other embodiments, a therapeutically effective amount of a T cell activating bispecific antigen binding molecule of the invention is administered to an individual for the treatment of disease.

For the prevention or treatment of disease, the appropriate dosage of a T cell activating bispecific antigen binding molecule of the invention (when used alone or in combination with one or more other additional therapeutic agents) will depend on the type of disease to be treated, the route of administration, the body weight of the patient, the type of T cell activating bispecific antigen binding molecule, the severity and course of the disease, whether the T cell activating bispecific antigen binding molecule is administered for preventive or therapeutic purposes, previous or concurrent therapeutic interventions, the patient's clinical history and response to the T cell activating bispecific antigen binding molecule, and the discretion of the attending physician. The practitioner responsible for administration will, in any event, determine the concentration of active ingredient(s) in a composition and appropriate dose(s) for the individual subject. Various dosing schedules including but not limited to single or multiple administrations over various time-points, bolus administration, and pulse infusion are contemplated herein.

The T cell activating bispecific antigen binding molecule is suitably administered to the patient at one time or over a series of treatments. Depending on the type and severity of the disease, about 1 µg/kg to 15 mg/kg (e.g. 0.1 mg/kg-10 mg/kg) of T cell activating bispecific antigen binding molecule can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the T cell activating bispecific antigen binding molecule would be in the range from about 0.005 mg/kg to about 10 mg/kg. In other non-limiting examples, a dose may also comprise from about 1 microgram/kg body weight, about 5 microgram/kg body weight, about 10 microgram/kg body weight, about 50 microgram/kg body weight, about 100 microgram/kg body weight, about 200 microgram/kg body weight, about 350 microgram/kg body weight, about 500 microgram/kg body weight, about 1 milligram/kg body weight, about 5 milligram/kg body weight, about 10 milligram/kg body weight, about 50 milligram/kg body weight, about 100 milligram/kg body weight, about 200 milligram/kg body weight, about 350 milligram/kg body weight, about 500 milligram/kg body weight, to about 1000 mg/kg body weight or more per administration, and any range derivable therein. In non-limiting examples of a derivable range from the numbers listed herein, a range of about 5 mg/kg body weight to about 100 mg/kg body weight, about 5 microgram/kg body weight to about 500 milligram/kg body weight, etc., can be administered, based on the numbers described above. Thus, one or more doses of about 0.5 mg/kg, 2.0 mg/kg, 5.0 mg/kg or 10 mg/kg (or any combination thereof) may be administered to the patient. Such doses may be administered intermittently, e.g. every week or every three weeks (e.g. such that the patient receives from about two to about twenty, or e.g. about six doses of the T cell activating bispecific antigen binding molecule). An initial higher loading dose, followed by one or more lower doses may be administered. However, other dosage regimens may be useful. The progress of this therapy is easily monitored by conventional techniques and assays.

The T cell activating bispecific antigen binding molecules of the invention will generally be used in an amount effective to achieve the intended purpose. For use to treat or prevent a disease condition, the T cell activating bispecific antigen binding molecules of the invention, or pharmaceutical compositions thereof, are administered or applied in a therapeutically effective amount. Determination of a therapeutically effective amount is well within the capabilities of those skilled in the art, especially in light of the detailed disclosure provided herein.

For systemic administration, a therapeutically effective dose can be estimated initially from in vitro assays, such as cell culture assays. A dose can then be formulated in animal models to achieve a circulating concentration range that includes the $IC_{50}$ as determined in cell culture. Such information can be used to more accurately determine useful doses in humans.

Initial dosages can also be estimated from in vivo data, e.g., animal models, using techniques that are well known in the art. One having ordinary skill in the art could readily optimize administration to humans based on animal data.

Dosage amount and interval may be adjusted individually to provide plasma levels of the 'I' cell activating bispecific antigen binding molecules which are sufficient to maintain therapeutic effect. Usual patient dosages for administration by injection range from about 0.1 to 50 mg/kg/day, typically from about 0.5 to 1 mg/kg/day. Therapeutically effective plasma levels may be achieved by administering multiple doses each day. Levels in plasma may be measured, for example, by HPLC.

In cases of local administration or selective uptake, the effective local concentration of the T cell activating bispecific antigen binding molecules may not be related to plasma concentration. One having skill in the art will be able to optimize therapeutically effective local dosages without undue experimentation.

A therapeutically effective dose of the T cell activating bispecific antigen binding molecules described herein will generally provide therapeutic benefit without causing substantial toxicity. Toxicity and therapeutic efficacy of a T cell activating bispecific antigen binding molecule can be determined by standard pharmaceutical procedures in cell culture or experimental animals. Cell culture assays and animal studies can be used to determine the $LD_{50}$ (the dose lethal to 50% of a population) and the $ED_{50}$ (the dose therapeutically effective in 50% of a population). The dose ratio between toxic and therapeutic effects is the therapeutic index, which can be expressed as the ratio $LD_{50}/ED_{50}$. T cell activating bispecific antigen binding molecules that exhibit large therapeutic indices are preferred. In one embodiment, the T cell activating bispecific antigen binding molecule according to the present invention exhibits a high therapeutic index. The data obtained from cell culture assays and animal studies can be used in formulating a range of dosages suitable for use in humans. The dosage lies preferably within a range of circulating concentrations that include the $ED_{50}$ with little or no toxicity. The dosage may vary within this range depending upon a variety of factors, e.g., the dosage form employed, the route of administration utilized, the condition of the subject, and the like. The exact formulation, route of administration and dosage can be chosen by the individual physician in view of the patient's condition (see, e.g., Fingl et at, 1975, in: The Pharmacological Basis of Therapeutics, Ch. 1, p. 1, incorporated herein by reference in its entirety). The attending physician for patients treated with T cell activating bispecific antigen binding molecules of the invention would know how and when to terminate, interrupt, or adjust administration due to toxicity, organ dysfunction, and the like. Conversely, the attending physician would also know to adjust treatment to higher levels if the clinical response were not adequate (precluding toxicity). The magnitude of an administered dose in the management of the disorder of interest will vary with the severity of the condition to be treated, with the route of administration, and the like. The severity of the condition may, for example, be evaluated, in part, by standard prognostic evaluation methods. Further, the dose and perhaps dose frequency will also vary according to the age, body weight, and response of the individual patient.

Other Agents and Treatments

The T cell activating bispecific antigen binding molecules of the invention may be administered in combination with one or more other agents in therapy. For instance, a T cell activating bispecific antigen binding molecule of the invention may be co-administered with at least one additional therapeutic agent. The term "therapeutic agent" encompasses any agent administered to treat a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is an immunomodulatory agent, a cytostatic agent, an inhibitor of cell adhesion, a cytotoxic agent, an activator of cell apoptosis, or an agent that increases the sensitivity of cells to apoptotic inducers. In a particular embodiment, the additional therapeutic agent is an anticancer agent, for example a microtubule disruptor, an antimetabolite, a topoisomerase inhibitor, a DNA intercalator, an alkylating agent, a hormonal therapy, a kinase inhibitor, a receptor antagonist, an activator of tumor cell apoptosis, or an antiangiogenic agent.

Such other agents are suitably present in combination in amounts that are effective for the purpose intended. The effective amount of such other agents depends on the amount of T cell activating bispecific antigen binding molecule used, the type of disorder or treatment, and other factors discussed above. The T cell activating bispecific antigen binding molecules are generally used in the same dosages and with administration routes as described herein, or about from 1 to 99% of the dosages described herein, or in any dosage and by any route that is empirically/clinically determined to be appropriate.

Such combination therapies noted above encompass combined administration (where two or more therapeutic agents are included in the same or separate compositions and separate administration, in which case, administration of the T cell activating bispecific antigen binding molecule of the invention can occur prior to, simultaneously, and/or following, administration of the additional therapeutic agent and/or adjuvant. T cell activating bispecific antigen binding molecules of the invention can also be used in combination with radiation therapy.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper pierceable by a hypodermic injection needle). At least one active agent in the composition is a T cell activating bispecific antigen binding molecule of the invention. The label or package insert indicates that the composition is used for treating the condition of choice. Moreover, the article of manufacture may comprise (a) a first container with a composition contained therein, wherein the composition comprises a T cell activating bispecific antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

EXAMPLES

The following are examples of methods and compositions of the invention. It is understood that various other embodiments may be practiced, given the general description provided above.

General Methods

Recombinant DNA Techniques

Standard methods were used to manipulate DNA as described in Sambrook et al., Molecular cloning: A laboratory manual; Cold Spring Harbor Laboratory Press, Cold Spring Harbor, N.Y., 1989. The molecular biological reagents were used according to the manufacturers' instructions. General information regarding the nucleotide sequences of human immunoglobulins light and heavy chains is given in: Kabat, E. A. et al., (1991) Sequences of Proteins of Immunological Interest, 5$^{th}$ ed., NIH Publication No. 91-3242.

DNA Sequencing

DNA sequences were determined by double strand sequencing.

Gene Synthesis

Desired gene segments where required were either generated by PCR using appropriate templates or were synthesized by Geneart A G (Regensburg, Germany) from synthetic oligonucleotides and PCR products by automated gene synthesis. In cases where no exact gene sequence was available, oligonucleotide primers were designed based on sequences from closest homologues and the genes were isolated by RT-PCR from RNA originating from the appropriate tissue. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow sub-cloning into the respective expression vectors. All constructs were designed with a 5'-end DNA sequence coding for a leader peptide which targets proteins for secretion in eukaryotic cells. SEQ ID NOs 154-162 give exemplary leader peptides and polynucleotide sequences encoding them, respectively.

Isolation of Primary Human Pan T Cells from PBMCs

Peripheral blood mononuclear cells (PBMCs) were prepared by Histopaque density centrifugation from enriched lymphocyte preparations (buffy coats) obtained from local blood banks or from fresh blood from healthy human donors. Briefly, blood was diluted with sterile PBS and carefully layered over a Histopaque gradient (Sigma, H8889). After centrifugation for 30 minutes at 450×g at room temperature (brake switched off), part of the plasma above the PBMC containing interphase was discarded. The PBMCs were transferred into new 50 ml Falcon tubes and tubes were filled up with PBS to a total volume of 50 ml. The mixture was centrifuged at room temperature for 10 minutes at 400×g (brake switched on). The supernatant was discarded and the PBMC pellet washed twice with sterile PBS (centrifugation steps at 4° C. for 10 minutes at 350×g). The resulting PBMC population was counted automatically (ViCell) and stored in RPMI1640 medium, containing 10% FCS and 1% L-alanyl-L-glutamine (Biochrom, K0302) at 37° C., 5% $CO_2$ in the incubator until assay start. T cell enrichment from PBMCs was performed using the Pan T Cell Isolation Kit II (Miltenyi Biotec #130-091-156), according to the manufacturer's instructions. Briefly, the cell pellets were diluted in 40 µl cold buffer per 10 million cells (PBS with 0.5% BSA. 2 mM EDTA, sterile filtered) and incubated with 10 µl Biotin-Antibody Cocktail per 10 million cells for 10 min at 4° C. 30 µl cold buffer and 20 µl Anti-Biotin magnetic beads per 10 million cells were added, and the mixture incubated for another 15 min at 4° C. Cells were washed by adding 10-20× the current volume and a subsequent centrifugation step at 300×g for 10 min. Up to 100 million cells were resuspended in 500 µl buffer. Magnetic separation of unlabeled human pan T cells was performed using LS columns (Miltenyi Biotec #130-042-401) according to the manufacturer's instructions. The resulting T cell population was counted automatically (ViCell) and stored in AIM-V medium at 37° C., 5% $CO_2$ in the incubator until assay start (not longer than 24 h).

Isolation of Primary Human Naive T Cells from PBMCs

Peripheral blood mononuclear cells (PBMCs) were prepared by Histopaque density centrifugation from enriched lymphocyte preparations (buffy coats) obtained from local blood banks or from fresh blood from healthy human donors. T-cell enrichment from PBMCs was performed using the Naive $CD8^+$ T cell isolation Kit from Miltenyi Biotec (#130-093-244), according to the manufacturer's instructions, but skipping the last isolation step of $CD8^+$ T cells (also see description for the isolation of primary human pan T cells).

Isolation of Murine Pan T Cells from Splenocytes

Spleens were isolated from C57BL/6 mice, transferred into a GentleMACS C-tube (Miltenyi Biotech #130-093-237) containing MACS buffer (PBS+0.5% BSA+2 mM EDTA) and dissociated with the GentleMACS Dissociator to obtain single-cell suspensions according to the manufacturer's instructions. The cell suspension was passed through a pre-separation filter to remove remaining undissociated tissue particles. After centrifugation at 400×g for 4 min at 4° C., ACK Lysis Buffer was added to lyse red blood cells (incubation for 5 min at room temperature). The remaining cells were washed with MACS buffer twice, counted and used for the isolation of murine pan T cells. The negative (magnetic) selection was performed using the Pan T Cell Isolation Kit from Miltenyi Biotec (#130-090-861), following the manufacturer's instructions. The resulting T cell population was automatically counted (ViCell) and immediately used for further assays.

Isolation of Primary Cynomolgus PBMCs from Heparinized Blood

Peripheral blood mononuclear cells (PBMCs) were prepared by density centrifugation from fresh blood from healthy cynomolgus donors, as follows: Heparinized blood was diluted 1:3 with sterile PBS, and Lymphoprep medium (Axon Lab #1114545) was diluted to 90% with sterile PBS. Two volumes of the diluted blood were layered over one volume of the diluted density gradient and the PBMC fraction was separated by centrifugation for 30 min at 520×g, without brake, at room temperature. The PBMC band was transferred into a fresh 50 ml Falcon tube and washed with sterile PBS by centrifugation for 10 min at 400×g at 4° C. One low-speed centrifugation was performed to remove the platelets (15 min at 150×g, 4° C.), and the resulting PBMC population was automatically counted (ViCell) and immediately used for further assays.

Target Cells

For the assessment of MCSP-targeting bispecific antigen binding molecules, the following tumor cell lines were used: the human melanoma cell line WM266-4 (ATCC #CRL-1676), derived from a metastatic site of a malignant melanoma and expressing high levels of human MCSP; and the human melanoma cell line MV-3 (a kind gift from The Radboud University Nijmegen Medical Centre), expressing medium levels of human MCSP.

For the assessment of CEA-targeting bispecific antigen binding molecules, the following tumor cell lines were used: the human gastric cancer cell line MKN45 (DSMZ #ACC 409), expressing very high levels of human CEA; the human female Caucasian colon adenocarcinoma cell line LS-174T (ECACC #87060401), expressing medium to low levels of human CEA; the human epithelioid pancreatic carcinoma cell line Panc-1 (ATCC #CRL-1469), expressing (very) low levels of human CEA; and a murine colon carcinoma cell line MC38-huCEA, that was engineered in-house to stably express human CEA.

In addition, a human T cell leukaemia cell line, Jurkat (ATCC #TIB-15 was used to assess binding of different bispecific constructs to human CD3 on cells.

Example 1

Preparation, Purification and Characterization of Bispecific Antigen Binding Molecules The heavy and light chain variable region sequences were subcloned in frame with either the constant heavy chain or the constant light chain pre-inserted into the respective recipient mammalian expression vector. The antibody expression was driven by an MPSV promoter and a synthetic polyA signal sequence is located at the 3' end of the CDS. In addition each vector contained an EBV OriP sequence.

The molecules were produced by co-transfecting HEK293 EBNA cells with the mammalian expression vectors. Exponentially growing HEK293 EBNA cells were transfected using the calcium phosphate method. Alternatively, HEK293 EBNA cells growing in suspension were transfected using polyethylenimine (PEI). For preparation of "1+1 IgG scFab, one armed/one armed inverted" constructs, cells were transfected with the corresponding expression vectors in a 1:1:1 ratio ("vector heavy chain":"vector light chain":"vector heavy chain-scFab"). For preparation of "2+1 IgG scFab" constructs, cells were transfected with the corresponding expression vectors in a 1:2:1 ratio ("vector heavy chain":"vector light chain":"vector heavy chain-scFab"). For preparation of "1+1 IgG Crossfab" constructs, cells were transfected with the corresponding expression vectors in a 1:1:1:1 ratio ("vector second heavy chain": "vector first light chain":"vector light chain Crossfab": "vector first heavy chain-heavy chain Crossfab"). For preparation of "2+1 IgG Crossfab" constructs cells were transfected with the corresponding expression vectors in a 1:2:1:1 ratio ("vector second heavy chain":"vector light chain":"vector first heavy chain-heavy chain Crossfab)": "vector light chain Crossfab". For preparation of the "2+1 IgG Crossfab, linked light chain" construct, cells were transfected with the corresponding expression vectors in a 1:1:1:1 ratio ("vector heavy chain":"vector light chain": "vector heavy chain (Crossfab-Fab-Fe)":"vector linked light chain"). For preparation of the "1+1 CrossMab" construct, cells were transfected with the corresponding expression vectors in a 1:1:1:1 ratio ("vector first heavy chain":"vector second heavy chain":"vector first light chain":"vector second light chain"). For preparation of the "1+1 IgG Crossfab light chain fusion" construct, cells were transfected with the corresponding expression vectors in a 1:1:1:1 ratio ("vector first heavy chain":"vector second heavy chain":"vector light chain Crossfab":"vector second light chain").

For transfection using calcium phosphate cells were grown as adherent monolayer cultures in T-flasks using DMEM culture medium supplemented with 10% (v/v) FCS, and transfected when they were between 50 and 80% confluent. For the transfection of a 1150 flask, 15 million cells were seeded 24 hours before transfection in 25 ml DMEM culture medium supplemented with FCS (at 10% v/v final), and cells were placed at 37° C. in an incubator with a 5% $CO_2$ atmosphere overnight. For each T150 flask to be transfected, a solution of DNA, $CaCl_2$ and water was prepared by mixing 94 μg total plasmid vector DNA divided in the corresponding ratio, water to a final volume of 469 μl and 469 μl of a 1 M $CaCl_2$ solution. To this solution, 938 μl of a 50 mM HEPES, 280 mM NaCl, 1.5 mM $Na_2HPO_4$ solution at pH 7.05 were added, mixed immediately for 10 s and left to stand at room temperature for 20 s. The suspension was diluted with 10 ml of DMEM supplemented with 2% (v/v) FCS, and added to the T150 in place of the existing medium. Subsequently, additional 13 ml of transfection medium were added. The cells were incubated at 37° C., 5% $CO_2$ for about 17 to 20 hours, then medium was replaced with 25 ml DMEM, 10% FCS. The conditioned culture medium was harvested approximately 7 days post-media exchange by centrifugation for 15 min at 210×g, sterile filtered (0.22·m filter), supplemented with sodium azide to a final concentration of 0.01% (w/v), and kept at 4° C.

For transfection using polyethylenimine (PEI) HEK293 EBNA cells were cultivated in suspension in serum free CD CHO culture medium. For the production in 500 ml shake flasks, 400 million HEK293 EBNA cells were seeded 24 hours before transfection. For transfection cells were centrifuged for 5 min at 210×g, and supernatant was replaced by 20 ml pre-warmed CD CHO medium. Expression vectors were mixed in 20 ml CD CHO medium to a final amount of 200 μg DNA. After addition of 540 μl PEI, the mixture was vortexed for 15 s and subsequently incubated for 10 min at room temperature. Afterwards cells were mixed with the DNA/PEI solution, transferred to a 500 ml shake flask and incubated for 3 hours at 37° C. in an incubator with a 5% $CO_2$ atmosphere. After the incubation time 160 ml F17 medium was added and cells were cultivated for 24 hours. One day after transfection 1 mM valproic acid and 7% Feed 1 (Lonza) were added. After a cultivation of 7 days, supernatant was collected for purification by centrifugation for 15 min at 210×g, the solution was sterile filtered (0.22 μm filter), supplemented with sodium azide to a final concentration of 0.01% w/v, and kept at 4° C.

The secreted proteins were purified from cell culture supernatants by Protein A affinity chromatography, followed by a size exclusion chromatography step.

For affinity chromatography supernatant was loaded on a HiTrap ProteinA HP column (CV=5 ml, GE Healthcare) equilibrated with 25 ml 20 mM sodium phosphate, 20 mM sodium citrate, pH 7.5 or 40 ml 20 mM sodium phosphate, 20 mM sodium citrate, 0.5 M sodium chloride, pH 7.5. Unbound protein was removed by washing with at least ten column volumes 20 mM sodium phosphate, 20 mM sodium citrate, 0.5 M sodium chloride pH 7.5, followed by an additional wash step using six column volumes 10 mM sodium phosphate, 20 mM sodium citrate, 0.5 M sodium chloride pH 5.45. Subsequently, the column was washed with 20 ml 10 mM MES, 100 mM sodium chloride, pH 5.0, and target protein was eluted in six column volumes 20 mM sodium citrate, 100 mM sodium chloride, 100 mM glycine, pH 3.0. Alternatively, target protein was eluted using a gradient over 20 column volumes from 20 mM sodium citrate, 0.5 M sodium chloride, pH 7.5 to 20 mM sodium citrate, 0.5 M sodium chloride, pH 2.5. The protein solution was neutralized by adding ¹/₁₀ of 0.5 M sodium phosphate, pH 8. The target protein was concentrated and filtrated prior to loading on a HiLoad Superdex 200 column (GE Healthcare) equilibrated with 25 mM potassium phosphate, 125 mM sodium chloride, 100 mM glycine solution of pH 6.7.

For the purification of 1+1 IgG Crossfab the column was equilibrated with 20 mM histidine, 140 mM sodium chloride solution of pH 6.0.

The protein concentration of purified protein samples was determined by measuring the optical density (OD) at 280 nm, using the molar extinction coefficient calculated on the basis of the amino acid sequence. Purity and molecular weight of the bispecific constructs were analyzed by SDS-PAGE in the presence and absence of a reducing agent (5 mM 1,4-dithiothreitol) and staining with Coomassie (SimpleBlue™ SafeStain from Invitrogen) using the NuPAGE® Pre-Cast gel system (Invitrogen, USA) was used according to the manufacturer's instructions (4-12% Tris-Acetate gels or 4-12% Bis-Tris). Alternatively, purity and molecular weight of molecules were analyzed by CE-SDS analyses in the presence and absence of a reducing agent, using the Caliper LabChip GXII system (Caliper Lifescience) according to the manufacturer's instructions.

The aggregate content of the protein samples was analyzed using a Superdex 200 10/300GL analytical size-exclusion chromatography column (GE Healthcare) in 2 mM MOPS, 150 mM NaCl, 0.02% (w/v) NaN$_3$, pH 7.3 running buffer at 25° C. Alternatively, the aggregate content of antibody samples was analyzed using a TSKgel G3000 SW XL analytical size-exclusion column (Tosoh) in 25 mkt K$_2$HPO$_4$, 125 mM NaCl, 200 mM L-arginine monohydrochloride, 0.02% (w/v) NaN$_3$, pH 6.7 running buffer at 2.5° C.

FIGS. 2-14 show the results of the SDS PAGE and analytical size exclusion chromatography and Table 2A shows the yields, aggregate content after Protein A, and final monomer content of the preparations of the different bispecific constructs.

Figure 47:
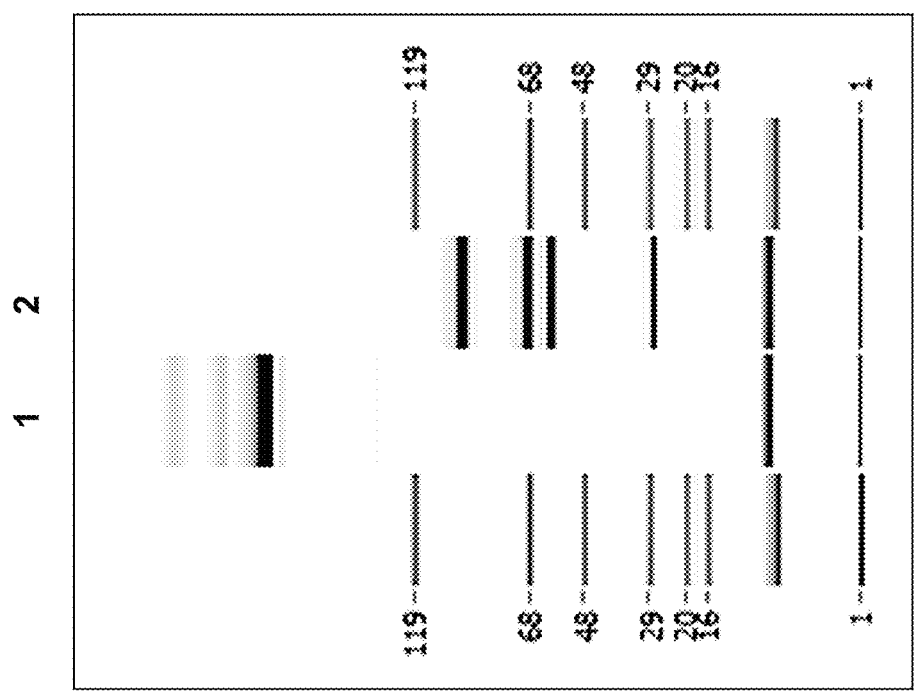
FIG. 47. CE-SDS analyses. Electropherogram shown as SDS PAGE of 2+1 IgG Crossfab, linked light chain (see SEQ ID NOs 3, 5, 29, 179). (lane 1: reduced, lane 2: non-reduced).
Figure 48:
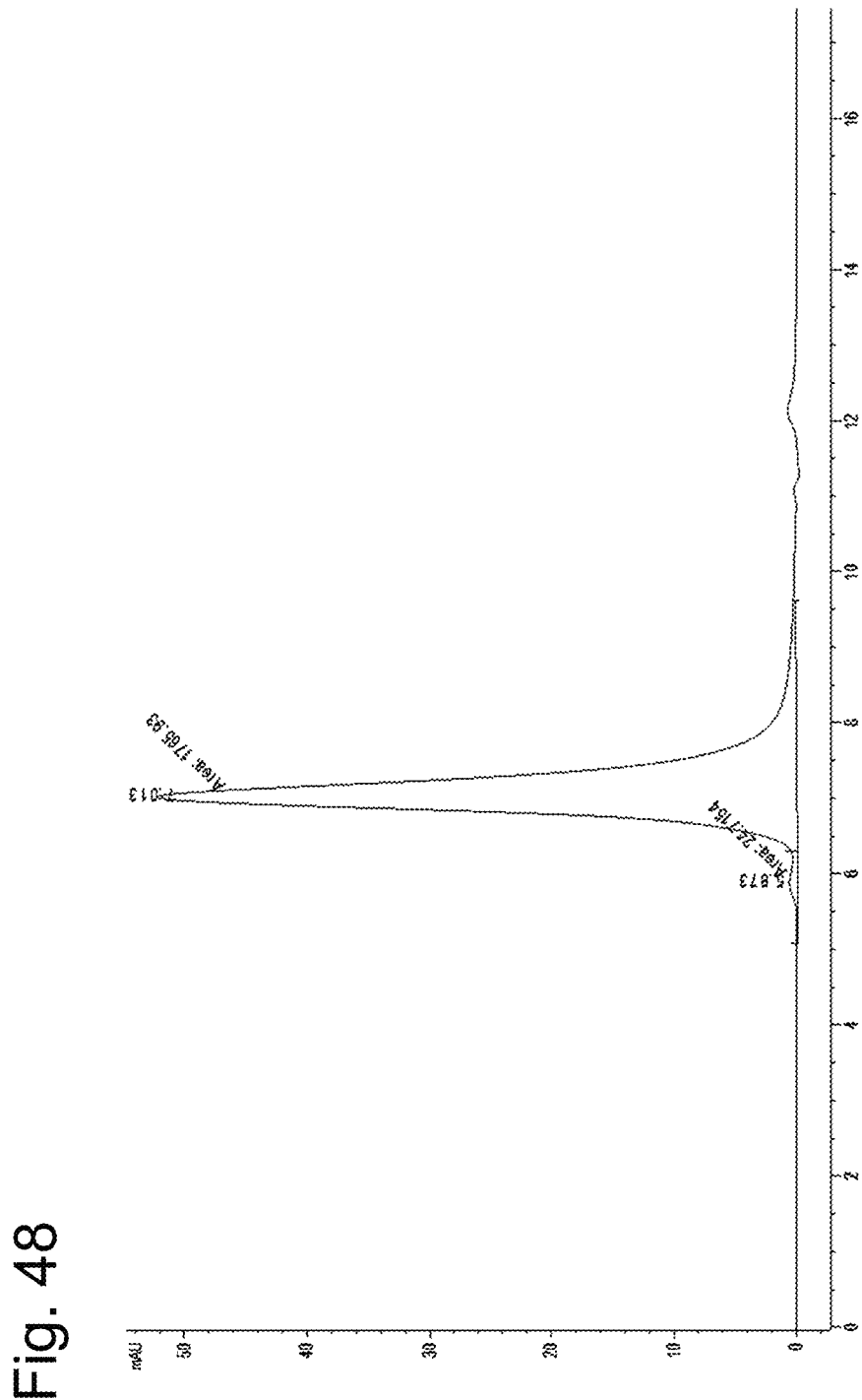
FIG. 48. Analytical size exclusion chromatography of 2+1 IgG Crossfab, linked light chain (see SEQ ID NOs 3, 5, 29, 179) (final product). 20 μg sample were injected.

FIG. 47 shows the result of the CE-SDS analyses of the anti-CD3/anti-MCSP bispecific "2+1 IgG Crossfab, linked light chain" construct (see SEQ ID NOs 3, 5, 29 and 179). 2 µg sample was used for analyses. FIG. 48 shows the result of the analytical size exclusion chromatography of the final product (20 µg sample injected).

FIG. 54 shows the results of the CE-SDS and SDS PAGE analyses of various constructs, and Table 2A shows the yields, aggregate content after Protein A and final monomer content of the preparations of the different bispecific constructs.

TABLE 2A

Yields, aggregate content after Protein A and final monomer content.

| Construct | Yield [mg/l] | Aggregate content after Protein A [%] | HMW [%] | LMW [%] | Monomer [%] |
|---|---|---|---|---|---|
| MCSP | | | | | |
| 2 + 1 IgG Crossfab; VH/VL exchange (LC007/V9) (SEQ ID NOs 3, 5, 29, 33) | 12.8 | 2.2 | 0 | 0 | 100 |
| 2 + 1 IgG Crossfab; VH/VL exchange (LC007/FN18) (SEQ ID NOs 3, 5, 35, 37) | 3.2 | 5.7 | 0.4 | 0 | 99.6 |
| 2 + 1 IgG scFab, P329G LALA (SEQ ID NOs 5, 21, 23) | 11.9 | 23 | 0.3 | 0 | 99.7 |
| 2 + 1 IgG scFab, LALA (SEQ ID NOs 5, 17, 19) | 9 | 23 | 0 | 0 | 100 |
| 2 + 1 IgG scFab, P329G LALA N297D (SEQ ID NOs 5, 25, 27) | 12.9 | 32.7 | 0 | 0 | 100 |
| 2 + 1 IgG scFab, wt (SEQ ID NOs 5, 13, 15) | 15.5 | 31.8 | 0 | 0 | 100 |
| 1 + 1 IgG scFab (SEQ ID NOs 5, 21, 213) | 7 | 24.5 | 0 | 0 | 100 |
| 1 + 1 IgG scFab "one armed" (SEQ ID NOs 1, 3, 5) | 7.6 | 43.7 | 2.3 | 0 | 97.7 |
| 1 + 1 IgG scFab "one armed inverted" (SEQ ID NOs 7, 9, 11) | 1 | 27 | 7.1 | 9.1 | 83.8 |
| 1 + 1 IgG Crossfab; VH/VL exchange (LC007/V9) (SEQ ID NOs 5, 29, 31, 33) | 9.8 | 0 | 0 | 0 | 100 |
| 2 + 1 IgG Crossfab, linked light chain; VL/VH exchange (LC007/V9) (SEQ ID NOs 3, 5, 29, 179) | 0.54 | 40 | 1.4 | 0 | 98.6 |
| 1 + 1 IgG Crossfab; VL/VH exchange (LC007/V9) (SEQ ID NOs 5, 29, 33, 181) | 6.61 | 8.5 | 0 | 0 | 100 |
| 1 + 1 CrossMab; CL/CH1 exchange (LC00/V9) (SEQ ID NOs 5, 23, 183, 185) | 6.91 | 10.5 | 1.3 | 1.7 | 97 |
| 2 + 1 IgG Crossfab, inverted; CL/CH1 exchange (LC007/V9) (SEQ ID NOs 5, 23, 183, 187) | 9.45 | 6.1 | 0.8 | 0 | 99.2 |
| 2 + 1 IgG Crossfab; VL/VH exchange (M4-3 ML2/V9) (SEQ ID NOs 33, 189, 191, 193) | 36.6 | 0 | 9.5 | 35.3 | 55.2 |
| 2 + 1 IgG Crossfab; CL/CH1 exchange (M4-3 ML2/V9) (SEQ ID NOs 183, 189, 193, 195) | 2.62 | 12 | 2.8 | 0 | 97.2 |

TABLE 2A-continued

Yields, aggregate content after Protein A and final monomer content.

| Construct | Yield [mg/l] | Aggregate content after Protein A [%] | HMW [%] | LMW [%] | Monomer [%] |
|---|---|---|---|---|---|
| 2 + 1 IgG Crossfab; CL/CH1 exchange (M4-3 ML2/H2C) (SEQ ID NOs 189, 193, 199, 201) | 29.75 | 0 | 0 | 0 | 100 |
| 2 + 1 IgG Crossfab; CL/CH1 exchange (LC007/anti-CD3) (SEQ ID NOs 5, 23, 215, 217) | 1.2 | 0 | 1.25 | 1.65 | 97.1 |
| 2 + 1 IgG Crossfab, inverted; CL/CH1 exchange (LC007/anti-CD3) (SEQ ID NOs 5, 23, 215, 219) | 7.82 | 0.5 | 0 | 0 | 100 |
| EGFR | | | | | |
| 2 + 1 IgG scFab (SEQ ID NOs 45, 47, 53) | 5.2 | 53 | 0 | 30 | 70 |
| 1 + 1 IgG scFab (SEQ ID NOs 47, 53, 213) | 3.4 | 66.6 | 0 | 1.6 | 98.4 |
| 1 + 1 IgG scFab "one armed" (SEQ ID NOs 43, 45, 47) | 9.05 | 60.8 | 0 | 0 | 100 |
| 1 + 1 IgG scFab "one armed inverted" (SEQ ID NOs 11, 49, 51) | 3.87 | 58.8 | 0 | 0 | 100 |
| FAP | | | | | |
| 2 + 1 IgG scFab (SEQ ID NOs 57, 59, 61) | 12.57 | 53 | 0 | 0 | 100 |
| 1 + 1 IgG scFab (SEQ ID NOs 57, 61, 213) | 17.95 | 41 | 0.4 | 0 | 99.6 |
| 1 + 1 IgG scFab "one armed inverted" (SEQ ID NOs 11, 51, 55) | 2.44 | 69 | 0.6 | 0 | 99.4 |
| CEA | | | | | |
| 2 + 1 IgG Crossfab, inverted; VL/VH exchange (CH1A1A/V9) (SEQ ID NOs 33, 63, 65, 67) | 0.34 | 13 | 4.4 | 0 | 95.6 |
| 2 + 1 IgG Crossfab, inverted; CL/CH1 exchange (CH1A1A/V9) (SEQ ID NOs 65, 67, 183, 197) | 12.7 | 43 | 0 | 0 | 100 |
| 2 + 1 IgG Crossfab, inverted; CL/CH1 exchange (431/26/V9) (SEQ ID NOs 183, 203, 205, 207) | 7.1 | 20 | 0 | 0 | 100 |
| 1 + 1 IgG-Crossfab light chain fusion (CH1A1A/V9) (SEQ ID NOs 183, 209, 211, 213) | 7.85 | 27 | 4.3 | 3.2 | 92.5 |

As controls, bispecific antigen binding molecules were generated in the prior art tandem scFv format ("(scFv)$_2$") and by fusing a tandem scFv to an Fc domain ("(scFv)$_2$-Fc"). The molecules were produced in HEK293-ERNA cells and purified by Protein A affinity chromatography followed by a size exclusion chromatographic step in an analogous manner as described above for the bispecific antigen binding molecules of the invention. Due to high aggregate formation, some of the samples had to be further purified by applying eluted and concentrated samples from the HiLoad Superdex 200 column (GE Healthcare) to a Superdex 10/300 GL column (GE Healthcare) equilibrated with 20 mM histidine, 140 mM sodium chloride, pH 6.7 in order to obtain protein with high monomer content. Subsequently, protein concentration, purity and molecular weight, and aggregate content were determined as described above.

Yields, aggregate content after the first purification step, and final monomer content for the control molecules is shown in Table 2B. Comparison of the aggregate content after the first purification step (Protein A) indicates the superior stability of the IgG Crossfab and IgG scFab constructs compared to the "(scFv)$_2$-Fc" and the disulfide bridge-stabilized "(dsscFv)$_2$-Fc" molecules.

TABLE 2B

Yields, aggregate content after Protein A and final monomer content.

| Construct | Yield [mg/l] | Aggregates after ProteinA [%] | Final HMW [%] | Final LMW [%] | Final Monomer [%] |
|---|---|---|---|---|---|
| (scFv)$_2$-Fc (antiMCSP/anti huCD3) | 76.5 | 40 | 0.5 | 0 | 99.5 |
| (dsscFv)$_2$-Fc (antiMCSP/anti huCD3) | 2.65 | 48 | 7.3 | 8.0 | 84.7 |

Thermal stability of the proteins was monitored by Dynamic Light Scattering (DLS), 30·g of filtered protein sample with a protein concentration of 1 mg/ml was applied in duplicate to a Dynapro plate reader (Wyatt Technology Corporation; USA). The temperature was ramped from 25 to 75° C. at 0.05° C./min, with the radius and total scattering intensity being collected. The results are shown in FIG. 15 and Table 2C. For the "(scFv)$_2$-Fc" (antiMCSP/anti huCD3)

molecule two aggregation points were observed, at 49° C. and 68° C. The "(dsscFv)$_2$-Fc" construct has an increased aggregation temperature (57° C.) as a result of the introduced disulfide bridge (FIG. 15 panel A, Table 2C). Both, the "2+1 IgG scFab" and the "2+1 IgG Crossfab" constructs are aggregating at temperatures higher than 60° C., demonstrating their superior thermal stability as compared to the "(scFv)$_2$-Fc" and "(dsscFv)$_2$-Fc" formats (FIG. 15 panel B, Table 2C).

TABLE 2C

Thermal stability determined by dynamic light scattering.

| Construct | $T_{agg}$ [° C.] |
|---|---|
| 2 + 1 IgG scFab (LC007/V9) | 68 |
| 2 + 1 IgG Crossfab (LC007/V9) | 65 |
| Fc-(scFv)2 (LC007/V9) | 49/68 |
| Fc-(dsscFv)2 (LC007/V9) | 57 |

Example 2

Surface Plasmon Resonance Analysis of Fc Receptor and Target Antigen Binding

Method

All surface plasmon resonance (SPR) experiments are performed on a Biacore T100 at 25° C. with HBS-EP as running buffer (0.01 M HEPES pH 7.4, 0.15 M NaCl, 3 mM EDTA, 0.005% Surfactant P20, Biacore, Freiburg/Germany).

Analysis of FcR Binding of Different Fc-variants

The assay setup is shown in FIG. 16 panel A. For analyzing interaction of different Fc-variants with human FcγRIIIa-V158 and murine FcγRIV direct coupling of around 6,500 resonance units (RU) of the anti-Penta His antibody (Qiagen) is performed on a CM5 chip at pH 5.0 using the standard amine coupling kit (Biacore, Freiburg/Germany). HuFcγRIIIa-V158-K6H6 and muFcγRIV-avi-His-biotin are captured for 60 s at 4 and 10 nM respectively.

Constructs with different Fc-mutations are passed through the flow cells for 120 s at a concentration of 1000 nM with a flow rate of 30 μl/min. The dissociation is monitored for 220 s. Bulk refractive index differences are corrected for by subtracting the response obtained in a reference flow cell. Here, the Fc-variants are flown over a surface with immobilized anti-Penta His antibody but on which HBS-EP has been injected rather than HuFcγRIIIa-V158-K6H6 or muFcγRIV-aviHis-biotin, Affinity for human FcγRIIIa-V158 and murine FcγRIV was determined for wild-type Fc using a concentration range from 500-4000 nM.

The steady state response was used to derive the dissociation constant $K_D$ by non-linear curve fitting of the Langmuir binding isotherm. Kinetic constants were derived using the Biacore T100 Evaluation Software (vAA, Biacore AB, Uppsala/Sweden), to fit rate equations for 1:1 Langmuir binding by numerical integration.

Result

The interaction of Fc variants with human FcγRIIIa and murine FcγRIV was monitored by surface plasmon resonance. Binding to captured huFcγRIIIa-V158-K6H6 and muFcγRIV-aviHis-biotin is significantly reduced for all analyzed Fc mutants as compared to the construct with a wild-type (wt) Fc domain.

The Fc mutants with the lowest binding to the human Fcγ-receptor were P329G L234A L235A (LALA) and P329G LALA N297D. The LALA mutation alone was not enough to abrogate binding to huFcγRIIIa-V158-K6H6. The Fc variant carrying only the LALA mutation had a residual binding affinity to human FcγRIIIa of 2.100 nM, while the wt Fc bound the human FcγRIIIa receptor with an affinity of 600 nM (Table 3). Both $K_D$ values were derived by binding model, using a single concentration.

Affinity to human FcγRIIIa-V158 and murine FcγRIV could only be analyzed for wt Fc. $K_D$ values are listed in Table 3. Binding to the murine FcγRIV was almost completely eliminated for all analyzed Fc mutants.

TABLE 3

Affinity of Fc-variants to the human FcγRIIIa-V158 and murine FcγRIV.

| | $K_D$ in nM T = 25° C. | | | |
|---|---|---|---|---|
| | human FcγRIIIa-V158 | | murine FcγRIV | |
| | kinetic | steady state | kinetic | steady state |
| Fc-wt (SEQ ID NOs 5, 13, 15) | 600* (1200) | 3470 | 576 | 1500 |
| Fc-LALA (SEQ ID NOs 5, 17, 19) | 2130* | n.d. | | n.d. |
| Fc-P329G LALA (SEQ ID NOs 5, 21, 23) | | n.d. | | n.d. |
| Fc-P329G LALA N297D (SEQ ID NOs 5, 25, 27) | | n.d. | | n.d. |

*determined using one concentration (1000 nM)

Analysis of Simultaneous Binding to Tumor Antigen and CD3

Analysis of simultaneous binding of the T-cell bispecific constructs to the tumor antigen and the human CDR was performed by direct coupling of 1650 resonance units (RU) of biotinylated D3 domain of MCSP on a sensor chip SA using the standard coupling procedure. Human EGFR was immobilized using standard amino coupling procedure. 8000 RU were immobilized on a CM5 sensor chip at pH 5.5. The assay setup is shown in FIG. 16 panel B.

Different T-cell bispecific constructs were captured for 60 s at 200 nM. Human CD3γ(G$_4$S)$_5$CD3ε-AcTev-Fc(knob)-Avi/Fc(hole) was subsequently passed at a concentration of 2000 nM and a flow rate of 40 μl/min for 60 s. Bulk refractive index differences were corrected for by subtracting the response obtained on a reference flow cell where the recombinant CD3ε was flown over a surface with immobilized D3 domain of MCSP or EGFR without captured. T-cell bispecific constructs.

Result

Figure 17A:
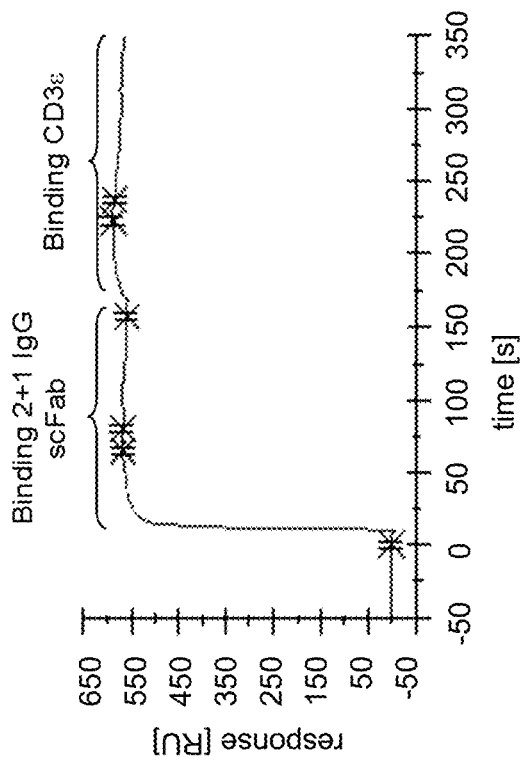
FIGS. 17A and 17B. Simultaneous binding of T-cell bispecific constructs to the D3 domain of human MCSP and human CD3γ(G$_4$S)$_5$CD3ε-AcTev-Fc(knob)-Avi/Fc(hole).
Figure 17B:
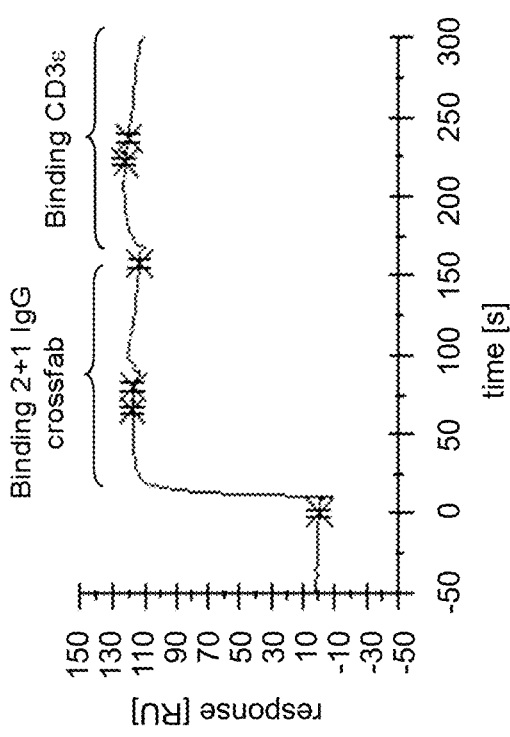
Figure 18A:
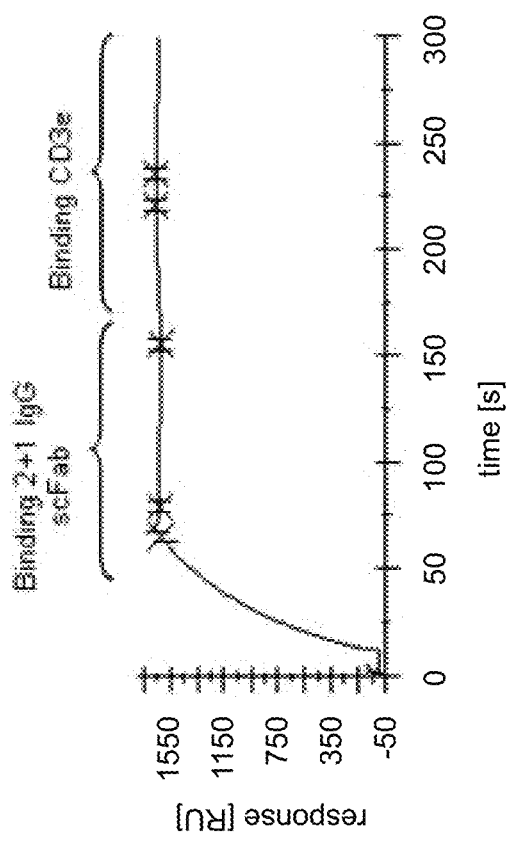
FIGS. 18A-18D. Simultaneous binding of T-cell bispecific constructs to human EGFR and human CD3γ(G$_4$S)$_5$CD3ε-AcTev-Fc(knob)-Avi/Fc(hole).
Figure 18B:
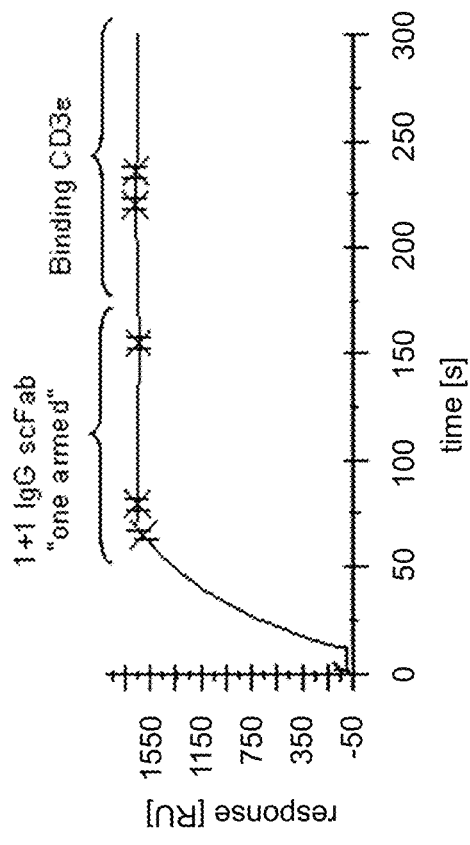
Figure 18C:
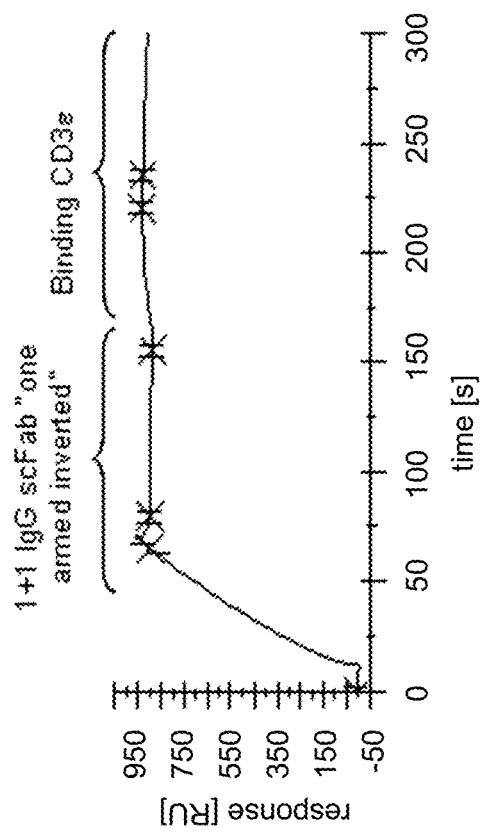
Figure 18D:
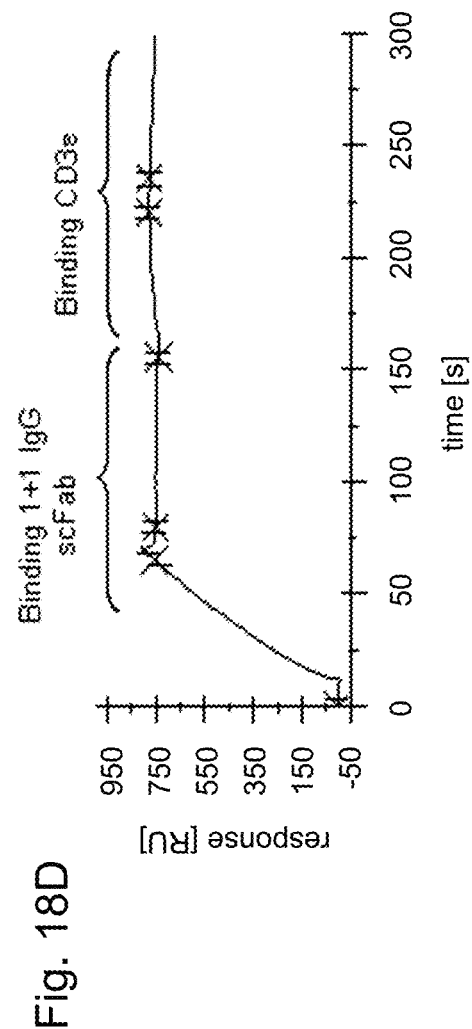

Simultaneous binding to both tumor antigen and human CD3ε was analyzed by surface plasmon resonance (FIG. 17, FIG. 18). All constructs were able to bind the tumor antigen and the CD3 simultaneously. For most of the constructs the binding level (RU) after injection of human CD3ε was higher than the binding level achieved after injection of the construct alone reflecting that both tumor antigen and the human CD3ε were bound to the construct.

Example 3

Binding of Bispecific Constructs to the Respective Target Antigen on Cells

Binding of the different bispecific constructs to CD3 on Jurkat cells (ATCC #TIB-152), and the respective tumor antigen on target cells, was determined by FACS. Briefly, cells were harvested, counted and checked for viability. 0.15-0.2 million cells per well (in PBS containing 0.1% BSA; 90 µl) were plated in a round-bottom 96-well plate and incubated with the indicated concentration of the bispecific constructs and corresponding IgG controls (10 µl) for 30 min at 4° C. For a better comparison, all constructs and IgG controls were normalized to same molarity. After the incubation, cells were centrifuged (5 min, 350×g), washed with 150 µl PBS containing 0.1% BSA, resuspended and incubated for further 30 min at 4° C. with 12 µl/well of a FITC- or PE-conjugated secondary antibody. Bound constructs were detected using a FACSCantoII (Software FACS Diva). The "(scFv)$_2$" molecule was detected using a FITC-conjugated anti-His antibody (Lucerna, #RHIS-45F-Z). For all other molecules, a FITC- or PE-conjugated AffiniPure F(ab')2 Fragment goat anti-human IgG Fcγ Fragment Specific (Jackson Immuno Research Lab #109-096-098/working solution 1:20, or #109-116-170/working solution 1:80, respectively) was used. Cells were washed by addition of 12.0 µl/well PBS containing 0.1% BSA and centrifugation at 350×g for 5 min. A second washing step was performed with 150 µl/well PBS containing 0.1% BSA. Unless otherwise indicated, cells were fixed with 100 µl/well fixation buffer (BD #554655) for 15 min at 4° C. in the dark, centrifuged for 6 min at 400×g and kept in 200 µl/well PBS containing 0.1% BSA until the samples were measured with FACS CantoII. EC50 values were calculated using the GraphPad Prism software.

In a first experiment, different bispecific constructs targeting human MCSP and human CD3 were analyzed by flow cytometry for binding to human CD3 expressed on Jurkat, human T cell leukaemia cells, or to human MCSP on Colo-38 human melanoma cells.

Figure 21B:
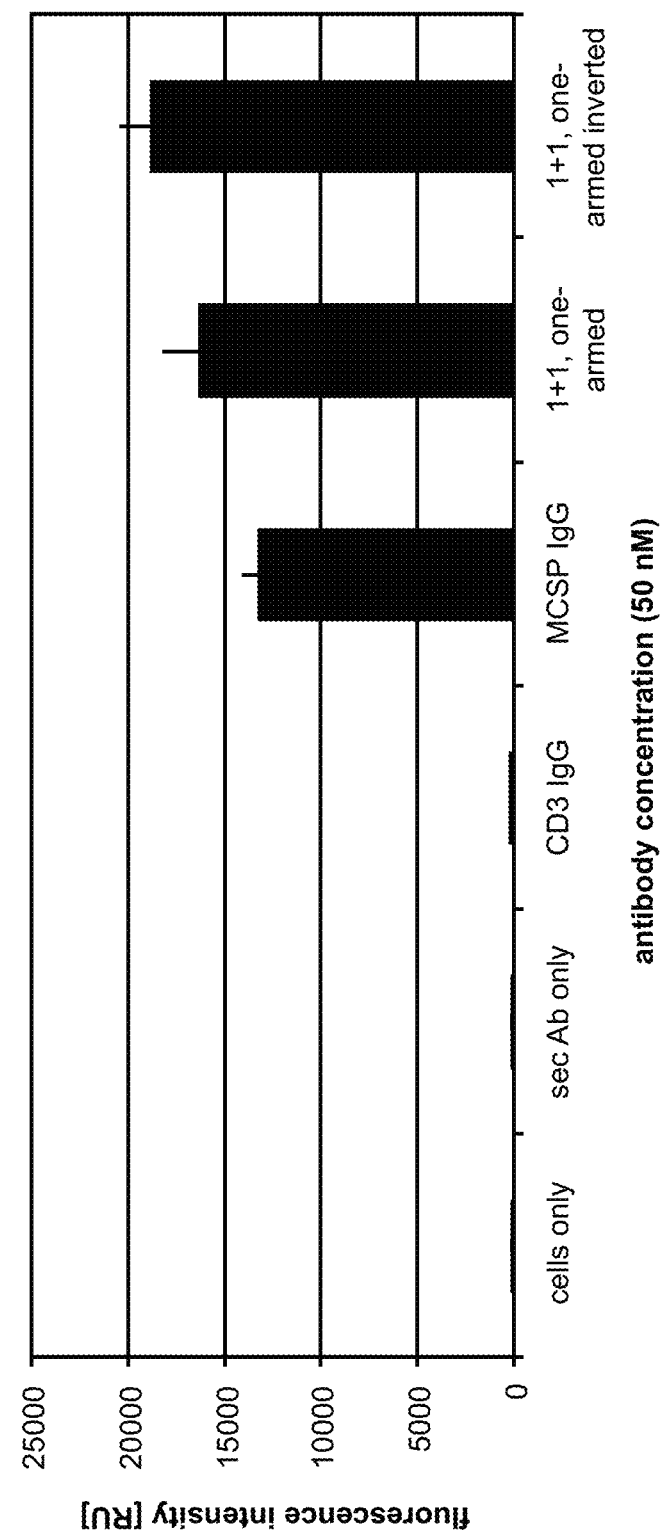

Results are presented in FIGS. 19-21, which show the mean fluorescence intensity of cells that were incubated with the bispecific molecule, control IgG, the secondary antibody only, or left untreated.

As shown in FIG. 19, for both antigen binding moieties of the "(scFv)$_2$" molecule, i.e. CD3 (FIG. 19, panel A) and MCSP (FIG. 19 panel B), a clear binding signal is observed compared to the control samples.

The "2+1 IgG scFab" molecule (SEQ ID NOs 5, 17, 19) shows good binding to huMCSP on Colo-38 cells (FIG. 20 panel A). The CD3 moiety binds CD3 slightly better than the reference anti-human CD3 IgG (FIG. 20 panel B).

As depicted in FIG. 21 panel A, the two "1+1" constructs show comparable binding signals to human CD3 on cells. The reference anti-human CD3 IgG gives a slightly weaker signal. In addition, both constructs tested ("1+1 IgG scFab, one-armed" (SEQ ID NOs 1, 3, 5) and "1+1 IgG scFab, one-armed inverted" (SEQ ID NOs 7, 9, 11)) show comparable binding to human MCSP on cells (FIG. 21 panel B). The binding signal obtained with the reference anti-human MCSP IgG is slightly weaker.

Figure 22:
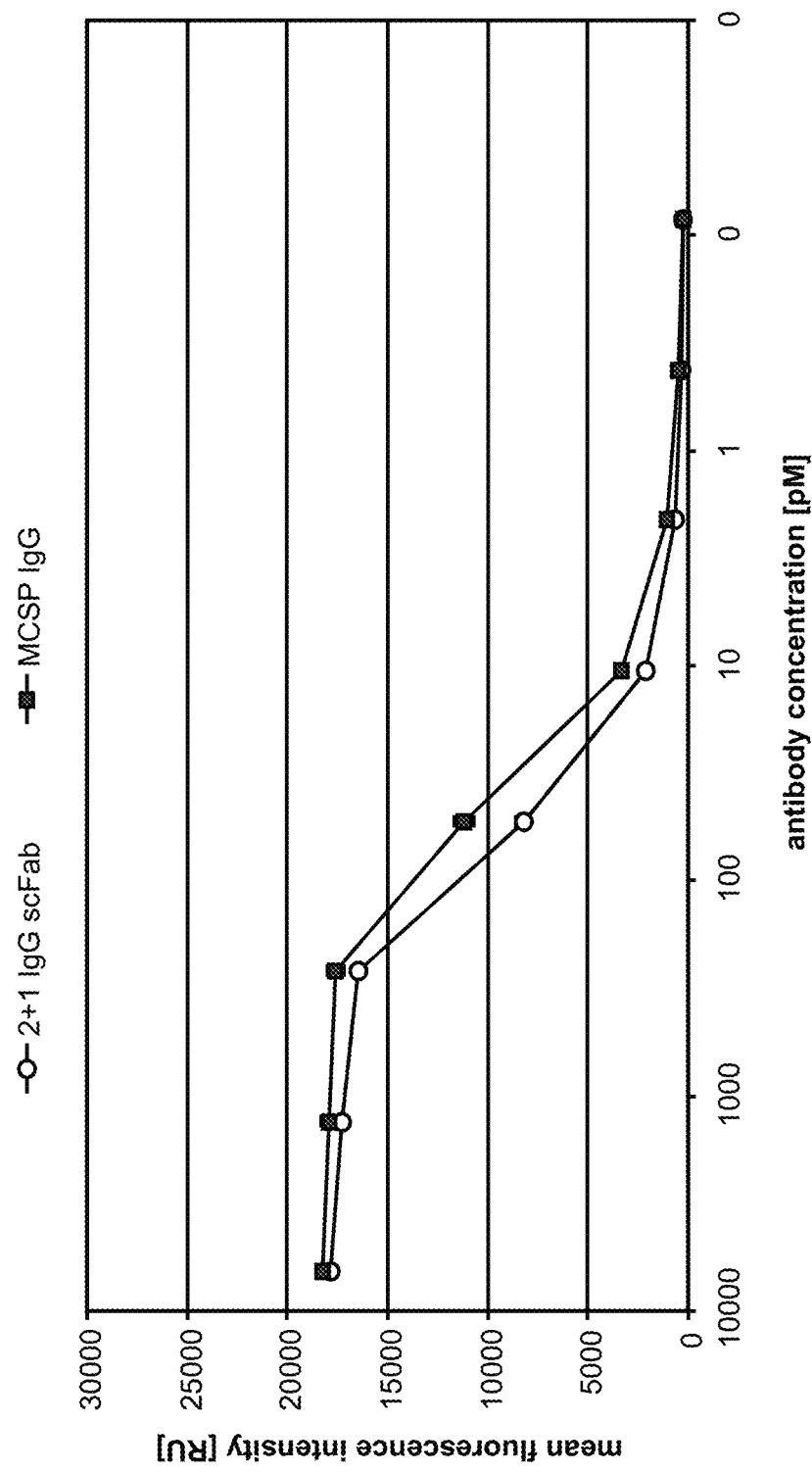
FIG. 22. Dose dependent binding of the "2+1 IgG scFab, LALA" (see SEQ ID NOs 5, 17, 19) bispecific construct and the corresponding anti-MCSP IgG to MCSP on Colo-38 cells as measured by FACS.

In another experiment, the purified "2+1 IgG scFab" bispecific construct (SEQ ID NOs 5, 17, 19) and the corresponding anti human MCSP IgG were analyzed by flow cytometry for dose-dependent binding to human MCSP on Colo-38 human melanoma cells, to determine whether the bispecific construct binds to MCSP via one or both of its "arms". As depicted in FIG. 22, the "2+1 IgG scFab" construct shows the same binding pattern as the MCSP IgG.

Figure 55B:
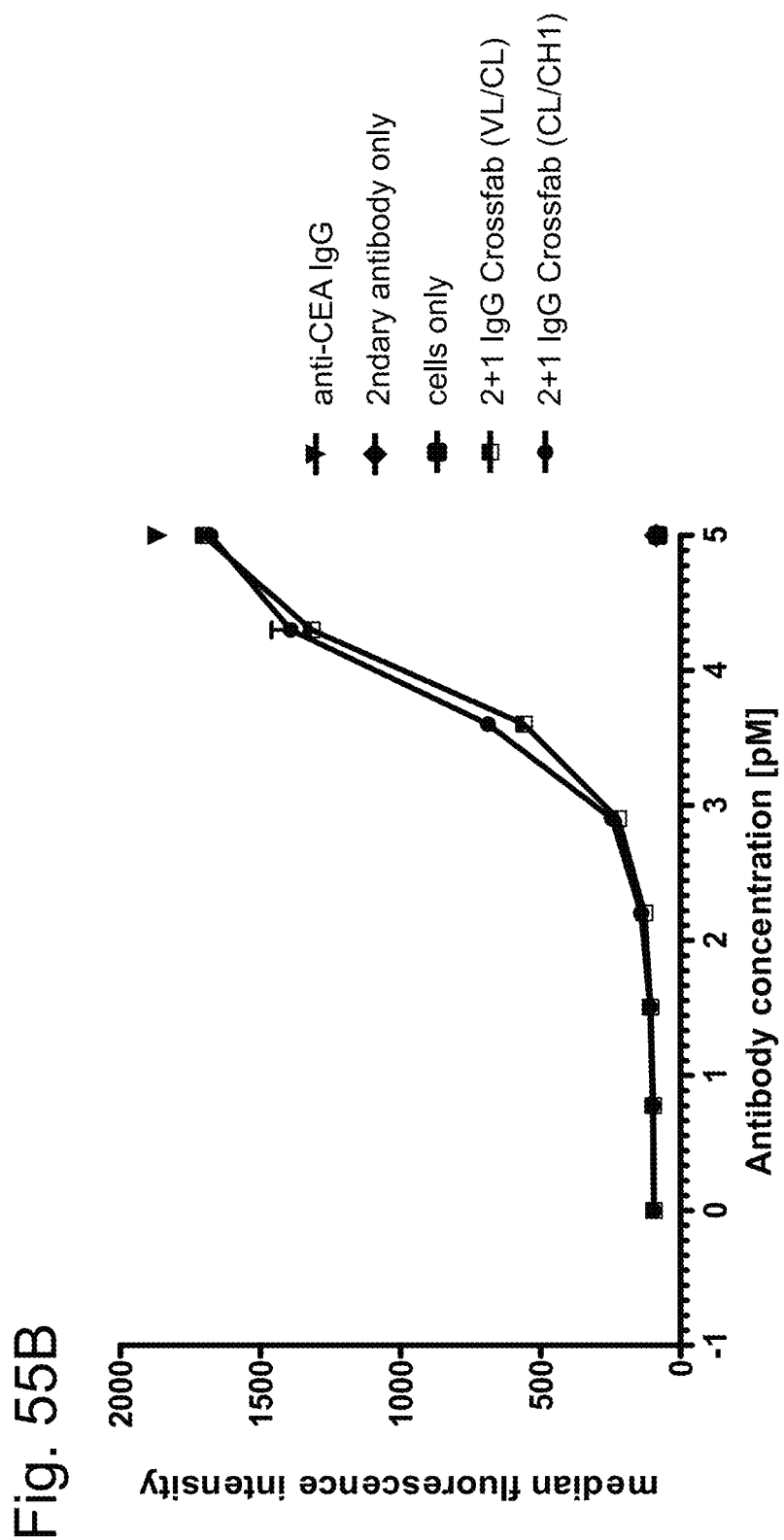

In yet another experiment, the binding of CD3/CEA "2+1 IgG Crossfab, inverted" bispecific constructs with either a VL/VH (see SEQ ID NOs 33, 63, 65, 67) or a CL/CH1 exchange (see SEQ ID NOs 66, 67, 183, 197) in the Crossfab fragment to human CD3, expressed by Jurkat cells, or to human CEA, expressed by LS-174T cells, was assessed. As a control, the equivalent maximum concentration of the corresponding IgGs and the background staining due to the labeled 2ndary antibody (goat anti-human FITC-conjugated AffiniPure F(ab')2 Fragment, Fcγ Fragment-specific, Jackson Immuno Research Lab #109-096-098) were assessed as well. As illustrated in FIG. 55, both constructs show good binding to human CEA, as well as to human CD3 on cells. The calculated EC50 values were 4.6 and 3.9 nM (CD3), and 9.3 and 6.7 (CEA) for the "2+1 IgG-Crossfab, inverted (VL/VH)" and the "2+1 IgG Crossfab, inverted (CL/CH1)" constructs, respectively.

Figure 56A:
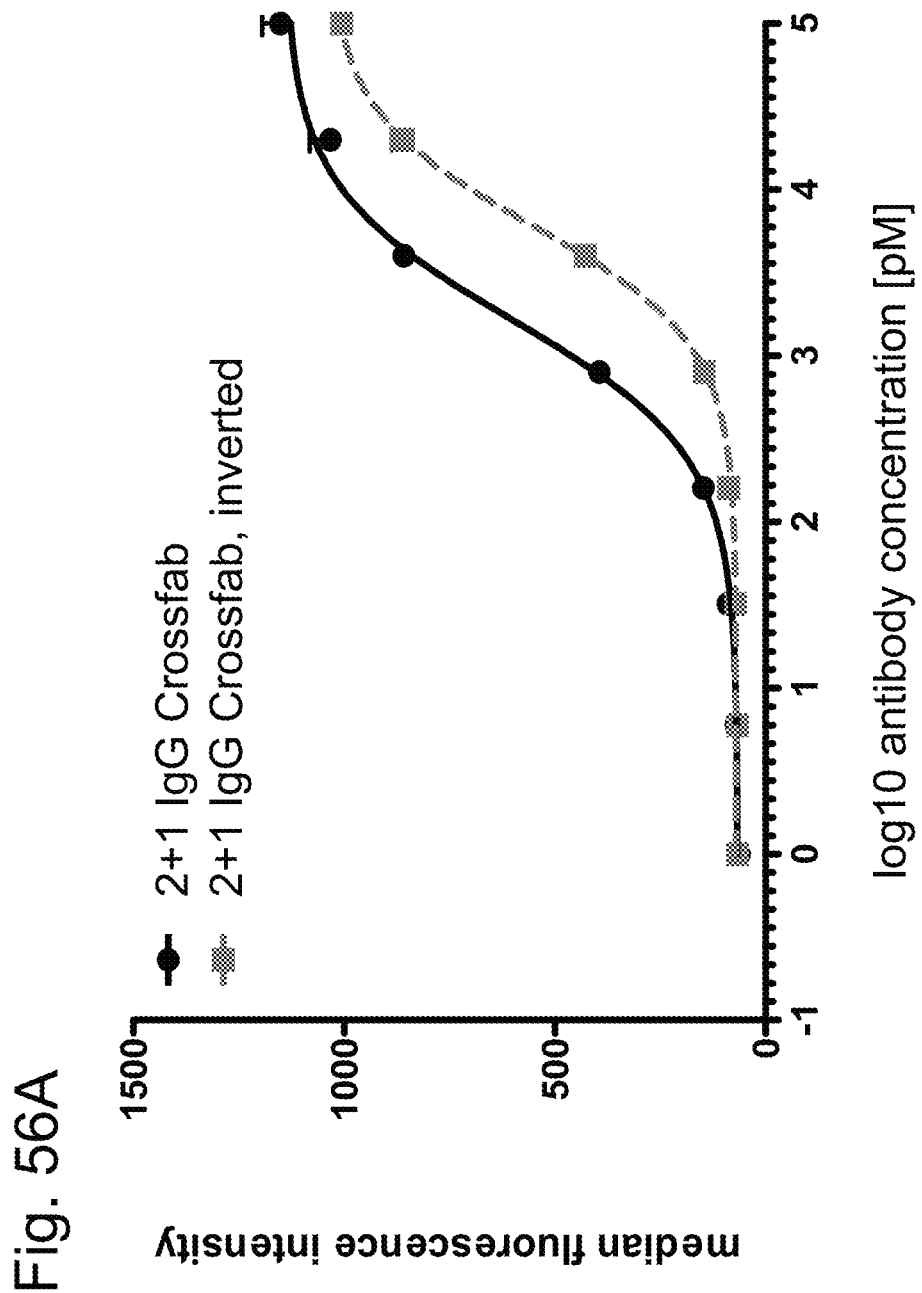
FIGS. 56A and 56B. Binding of bispecific constructs (MCSP/CD3 "2+1 IgG Crossfab" (see SEQ ID NOs 3, 5, 29, 33) and "2+1 IgG Crossfab, inverted" (see SEQ ID NOs 5, 23, 183, 187)) to human CD3, expressed by Jurkat cells (FIG. 56A), or to human MCSP, expressed by WM266-4 tumor cells (FIG. 56B) as determined by FACS.
Figure 56B:
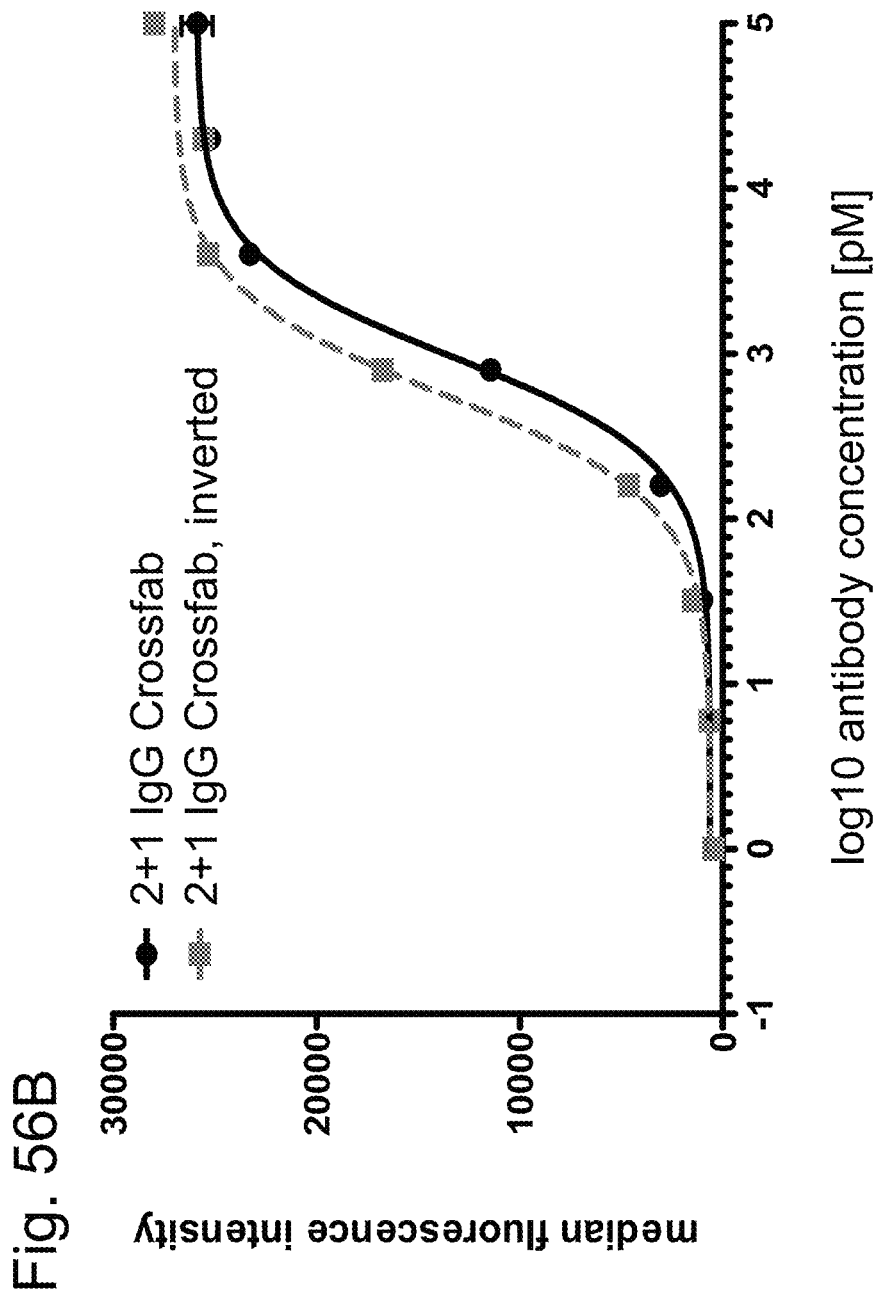

In another experiment, the binding of CD3/MCSP "2+1 IgG Crossfab" (see SEQ ID NOs 3, 5, 29, 33) and "2+1 IgG Crossfab, inverted" (see SEQ ID NOs 5, 23, 183, 187) constructs to human CD3, expressed by Jurkat cells, or to human MCSP, expressed by WM266-4 cells, was assessed. FIG. 56 shows that, while binding of both constructs to MCSP on cells was comparably good, the binding of the "inverted" construct to CD3 was reduced compared to the other construct. The calculated EC50 values were 6.1 and 1.66 nM (CD3), and 0.57 and 0.95 nM (MCSP) for the "2+1 IgG Crossfab, inverted" and the "2+1 IgG Crossfab" constructs, respectively.

Figure 57B:
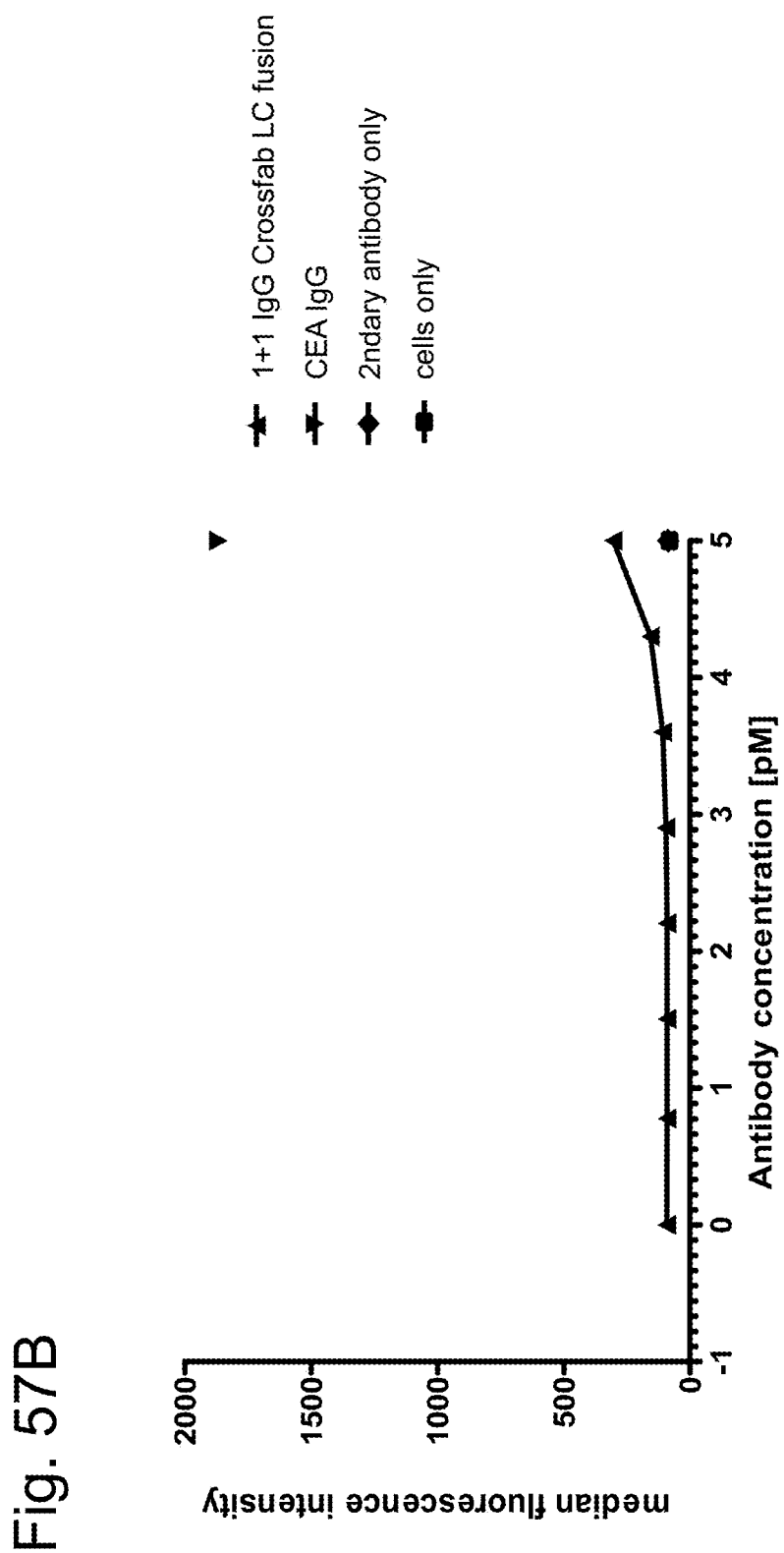

In a further experiment, binding of the "1+1 IgG Crossfab light chain (LC) fusion" construct (SEQ ID NOs 183, 209, 211, 213) to human CD3, expressed by Jurkat cells, and to human CEA, expressed by LS-174T cells was determined. As a control, the equivalent maximum concentration of the corresponding anti-CD3 and anti-CEA IgGs and the background staining due to the labeled 2ndary antibody (goat anti-human FITC-conjugated AffiniPure F(ab')2 Fragment, Fcγ Fragment-specific, Jackson Immuno Research Lab #109-096-098) were assessed as well. As depicted in FIG. 57, the binding of the "1+1 IgG Crossfab LC fusion" to CEA appears to be greatly reduced, whereas the binding to CD3 was at least comparable to the reference IgG.

Figure 58A:
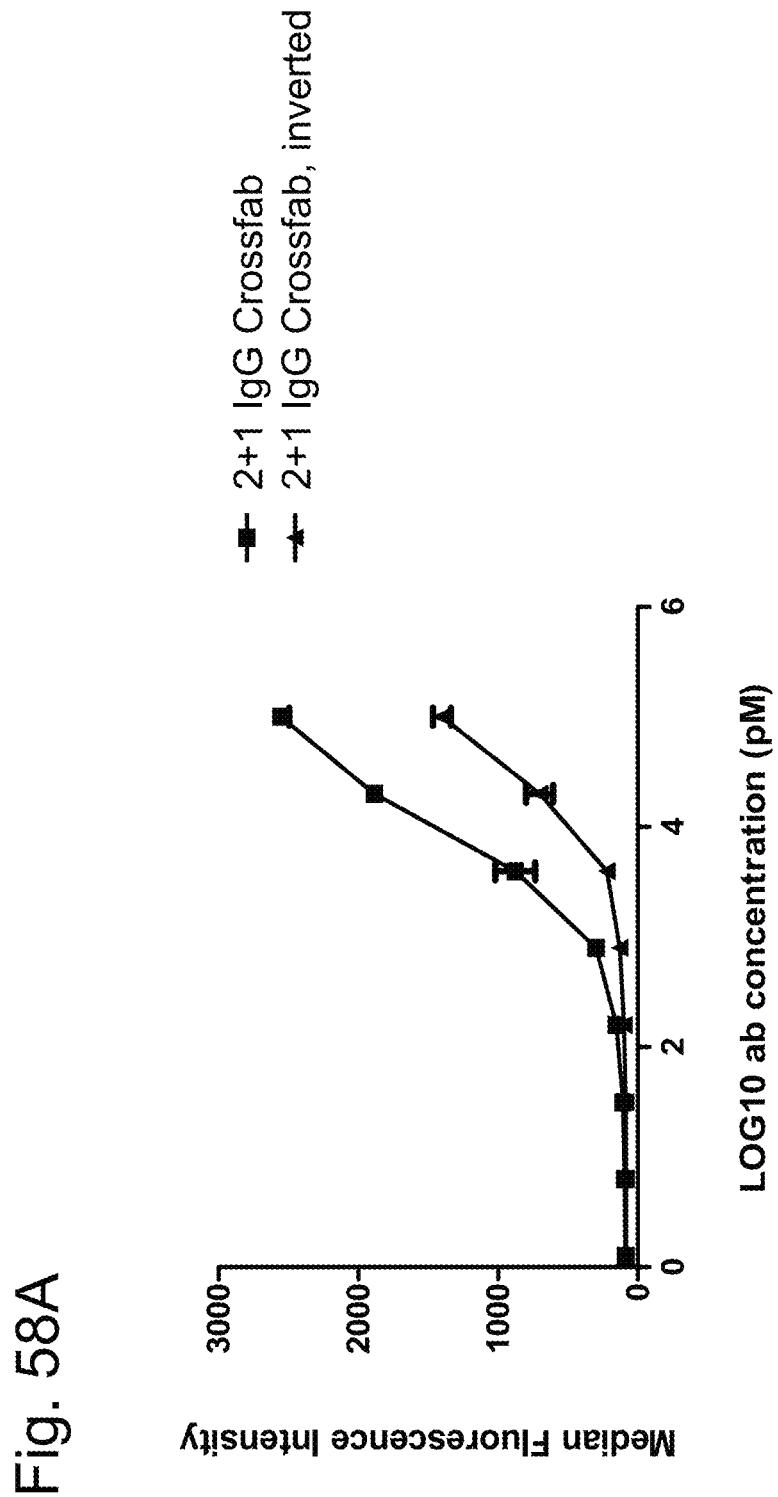
FIGS. 58A and 58B. Binding of the "2+1 IgG Crossfab" (see SEQ ID NOs 5, 23, 215, 217) and the "2+1 IgG Crossfab, inverted" (see SEQ ID NOs 5, 23, 215, 219) constructs to human CD3, expressed by Jurkat cells (FIG. 58A), or human MCSP, expressed by WM266-4 tumor cells (FIG. 58B) as determined by FACS.
Figure 58B:
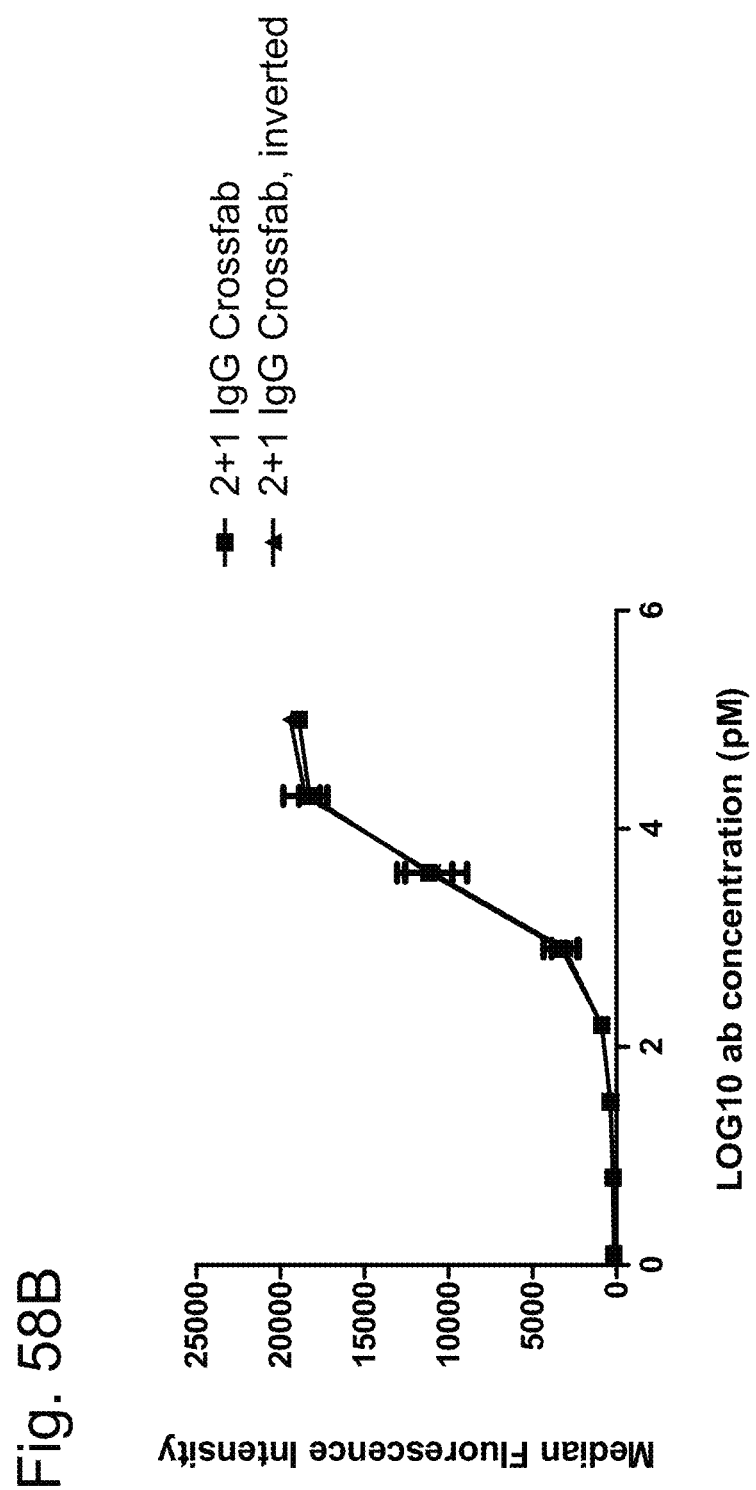

In a final experiment, binding of the "2+1 IgG Crossfab" (SEQ ID NOs 5, 23, 215, 217) and the "2+1 IgG Crossfab, inverted" (SEQ ID NOs 5, 23, 215, 219) constructs to human CD3, expressed by Jurkat cells, and to human MCSP, expressed by WM266-4 tumor cells was determined. As depicted in FIG. 58 the binding to human CD3 was reduced for the "2+1 IgG Crossfab, inverted" compared to the other construct, but the binding to human MCSP was comparably good. The calculated EC50 values were 10.3 and 32.0 nM (CD3), and 3.1 and 3.4 nM (MCSP) for the "2+1 IgG Crossfab" and the "2+1 IgG Crossfab, inverted" construct, respectively.

Example 4

FACS Analysis of Surface Activation Markers on Primary Human T Cells Upon Engagement of Bispecific Constructs The purified huMCSP-huCD3-targeting bispecific "2+1 IgG scFab" (SEQ ID NOs 5, 17, 19) and "(scFv)$_2$" molecules were tested by flow cytometry for their potential to up-regulate the early surface activation marker CD69, or the late activation marker CD25 on CD8+ T cells in the presence of human MCSP-expressing tumor cells.

Briefly, MCSP-positive Colo-38 cells were harvested with Cell Dissociation buffer, counted and checked for viability. Cells were adjusted to 0.3×10$^6$ (viable) cells per ml in AIM-V medium, 100 µl of this cell suspension per well were pipetted into a round-bottom 96-well plate (as indicated). 50

µl of the (diluted) bispecific construct were added to the cell-containing wells to obtain a final concentration of 1 nM. Human PBMC effector cells were isolated from fresh blood of a healthy donor and adjusted to 6×10⁶ (viable) cells per ml in AIM-V medium. 50 µl of this cell suspension was added per well of the assay plate (see above) to obtain a final E:T ratio of 10:1. To analyze whether the bispecific constructs are able to activate T cells exclusively in the presence of target cells expressing the tumor antigen huMCSP, wells were included that contained 1 nM of the respective bispecific molecules, as well as PBMCs, but no target cells.

After incubation for 15 h (CD69), or 24 h (CD25) at 37° C., 5% $CO_2$, cells were centrifuged (5 min, 350×g) and washed twice with 150 µl/well PBS containing 0.1% BSA. Surface staining for CD8 (mouse IgG1, κ, clone HIT8a; BD #555635), CD69 (mouse IgG1, clone L78; BD #340560) and CD25 (mouse IgG1, κ; clone M-A251; BD #555434) was performed at 4° C. for 30 min, according to the supplier's suggestions. Cells were washed twice with 150 PBS containing 0.1% BSA and fixed for 15 min at 4° C., using 100 µl/well fixation buffer (BD #554655). After centrifugation, the samples were resuspended in 200 µl/well PBS with 0.1% BSA and analyzed using a FACS CantoII machine (Software FACS Diva).

Figure 23A:
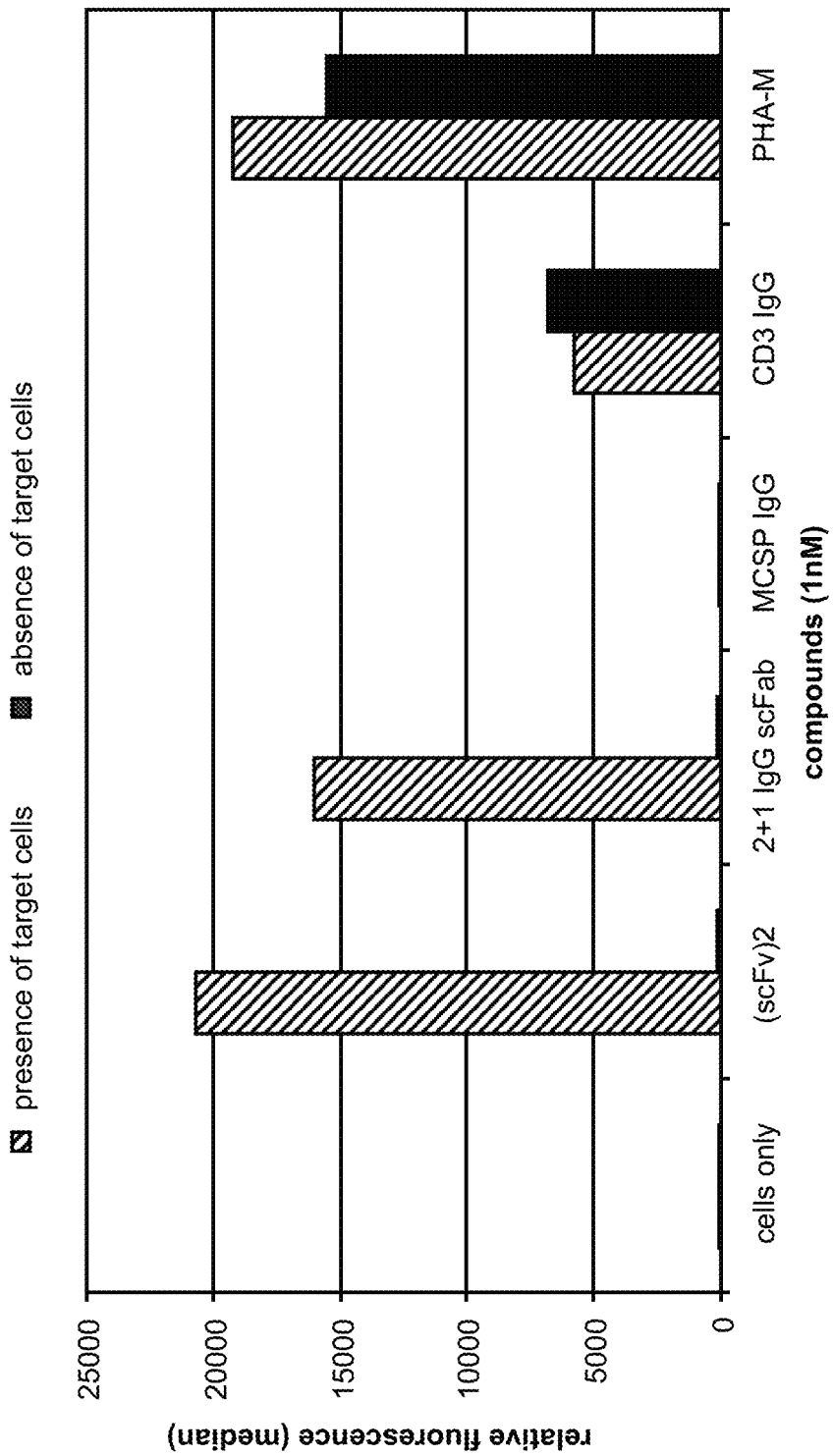
FIGS. 23A and 23B. Surface expression level of different activation markers on human T cells after incubation with 1 nM of "2+1 IgG scFab, LALA" (see SEQ ID NOs 5, 17, 19) or "(scFv)$_2$" CD3-MCSP bispecific constructs in the presence or absence of Colo-38 tumor target cells, as indicated (E:T ratio of PBMCs to tumor cells=10:1). Depicted is the expression level of the early activation marker CD69 (FIG. 23A), or the late activation marker CD25 (FIG. 23B) on CD8$^+$ T cells after 15 or 24 hours incubation, respectively.
Figure 23B:
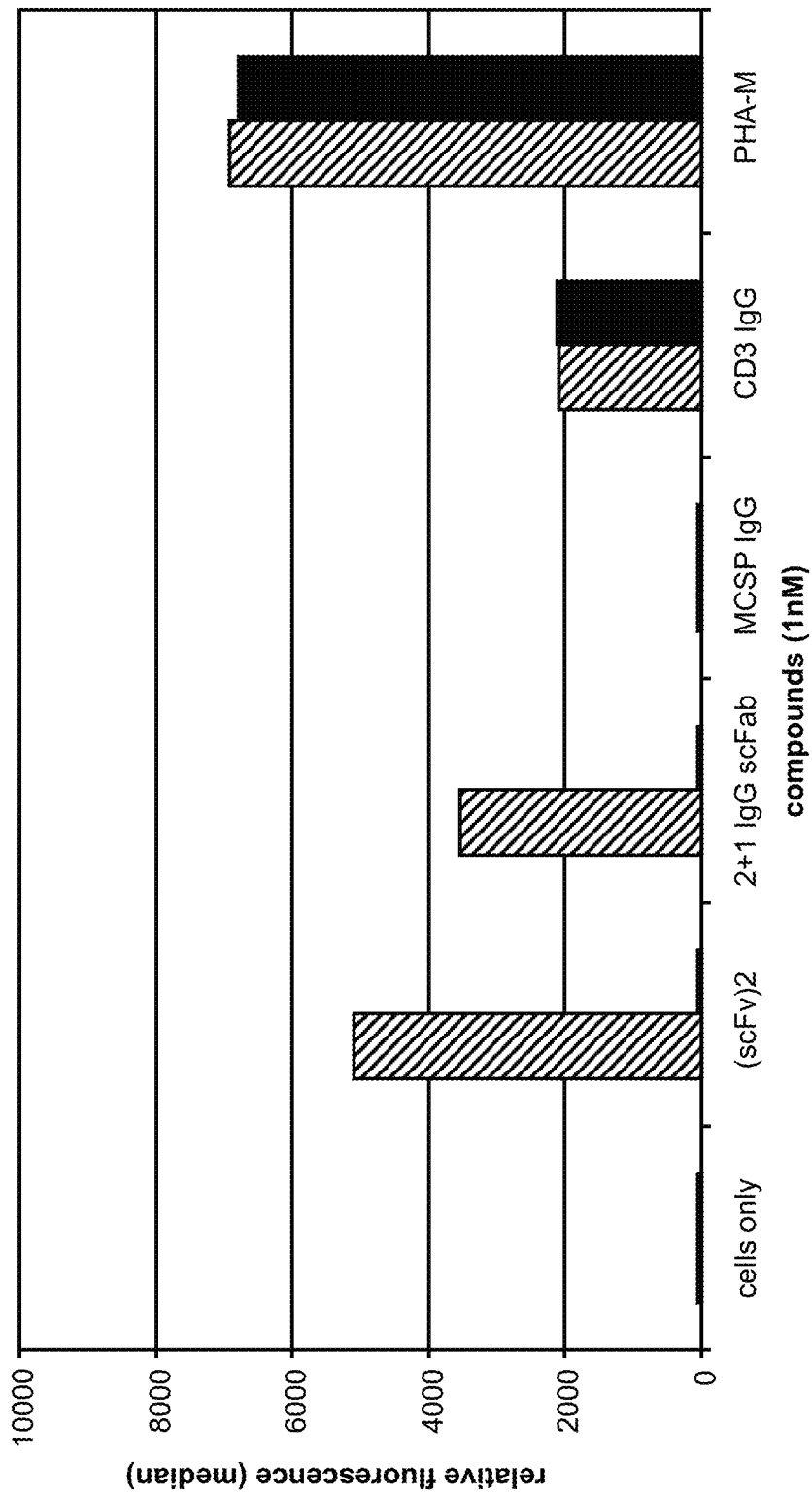

FIG. 23 depicts the expression level of the early activation marker CD69 (A), or the late activation marker CD25 (13) on CD8⁺ T cells after 15 hours or 24 hours incubation, respectively. Both constructs induce up-regulation of both activation markers exclusively in the presence of target cells. The "(scFv)₂" molecule seems to be slightly more active in this assay than the "2+1 IgG scFab" construct.

The purified huMCSP-huCD3-targeting bispecific "2+1 IgG scFab" and "(scFv)₂" molecules were further tested by flow cytometry for their potential to up-regulate the late activation marker CD25 on CD8⁺ T cells or CD4⁻ T cells in the presence of human MCSP-expressing tumor cells. Experimental procedures were as described above, using human pan T effector cells at an E:T ratio of 5:1 and an incubation time of five days.

Figure 24B:
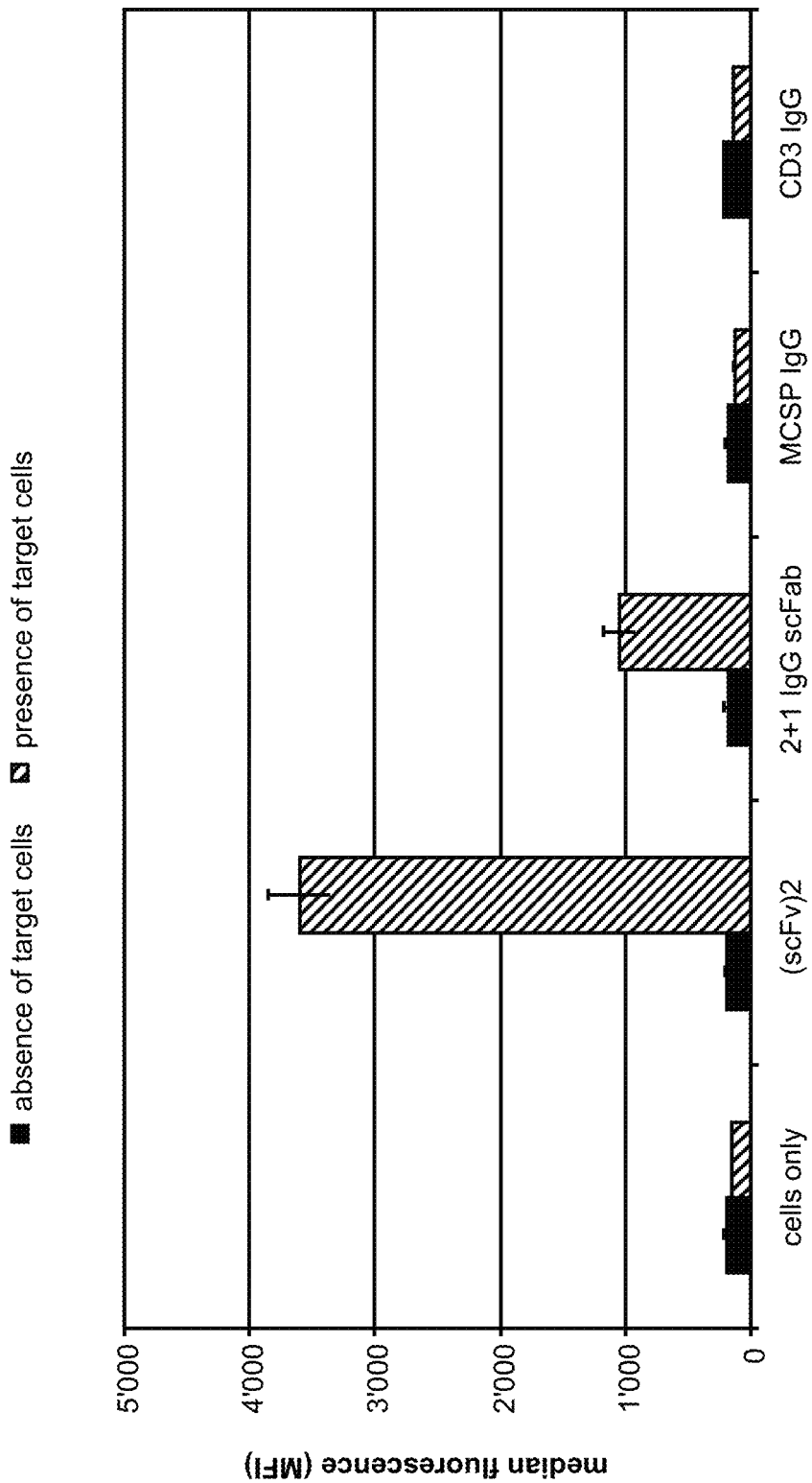

FIG. 24 shows that both constructs induce up-regulation of CD25 exclusively in the presence of target cells on both, CD8⁺ (A) as well as CD4⁺ (B) T cells. The "2+1 IgG scFab" construct seems to induce less up-regulation of CD25 in this assay, compared to the "(scFv)₂" molecule. In general, the up-regulation of CD25 is more pronounced on CD8⁺ than on CD4⁻ T cells.

Figure 25:
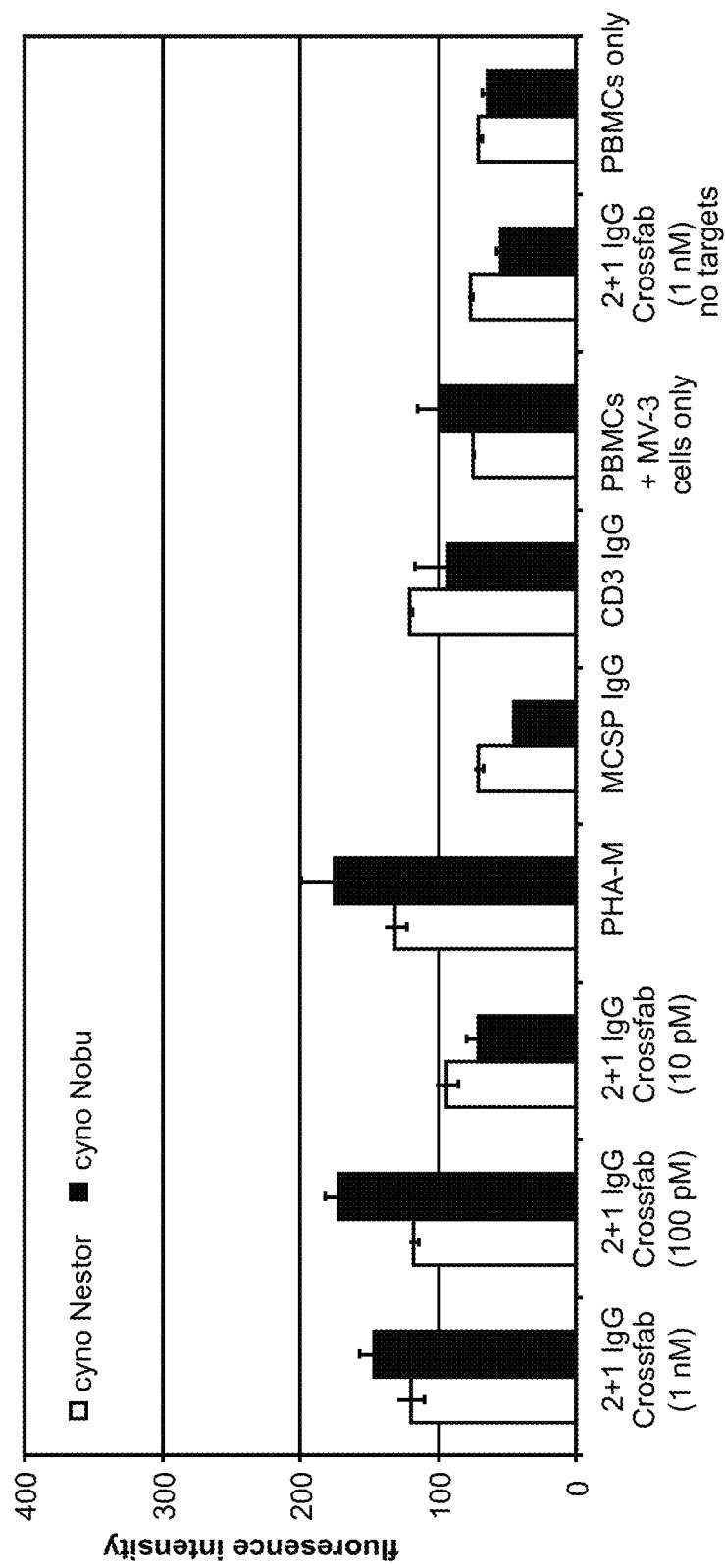
FIG. 25. Surface expression level of the late activation marker CD25 on cynomolgus CD8$^+$ cells from two different animals (cyno Nestor, cyno Nobu) after 43 hours incubation with the indicated concentrations of the "2+1 IgG Crossfab" bispecific construct (targeting cynomolgus CD3 and human MCSP; see SEQ ID NOs 3, 5, 35, 37), in the presence or absence of human MCSP-expressing MV-3 tumor target cells (E:T ratio=3:1). As controls, the reference IgGs (anti-cynomolgus CD3 IgG, anti-human MCSP IgG) or the unphysiologic stimulus PHA-M were used.

In another experiment, purified "2+1 IgG Crossfab" targeting cynomolgus CD3 and human MCSP (SEQ ID NOs 3, 5, 35, 37) was analyzed for its potential to up-regulate the surface activation marker CD25 on CD8⁺ T cells in the presence of tumor target cells. Briefly, human MCSP-expressing MV-3 tumor target cells were harvested with Cell Dissociation Buffer, washed and resuspended in DMEM containing 2% FCS and 1% GlutaMax. 30,000 cells per well were plated in a round-bottom 96-well plate and the respective antibody dilution was added at the indicated concentrations (FIG. 25). The bispecific construct and the different IgG controls were adjusted to the same molarity. Cynomolgus PBMC effector cells, isolated from blood of two healthy animals, were added to obtain a final E:T ratio of 3:1. After an incubation for 43 h at 37° C., 5% $CO_2$, the cells were centrifuged at 350×g for 5 min and washed twice with PBS, containing 0.1% BSA. Surface staining for CD8 (Miltenyi Biotech #130-080-601) and CD25 (BD #557138) was performed according to the supplier's suggestions. Cells were washed twice with 150 µl/well PBS containing 0.1% BSA and fixed for 15 min at 4° C., using 100 fixation buffer (BD #554655). After centrifugation, the samples were resuspended in 200 µl/well PBS with 0.1% BSA and analyzed using a FACS Canton machine (Software FACS Diva).

As depicted in FIG. 25, the bispecific construct induces concentration-dependent up-regulation of CD25 on CD8⁺ T cells only in the presence of target cells. The anti cyno CD3 IgG (clone FN-18) is also able to induce up-regulation of CD25 on CD8⁺ T cells, without being crosslinked (see data obtained with cyno Nestor). There is no hyperactivation of cyno T cells with the maximal concentration of the bispecific construct (in the absence of target cells).

In another experiment, the CD3-MCSP "2+1 IgG Crossfab, linked light chain" (see SEQ ID NOs 3, 5, 29, 179) was compared to the CD3-MCSP "2+1 IgG Crossfab" (see SEQ NOs 3, 5, 29, 33) for its potential to up-regulate the early activation marker CD69 or the late activation marker CD25 on CD8⁺ T cells in the presence of tumor target cells. Primary human PBMCs (isolated as described above) were incubated with the indicated concentrations of bispecific constructs for at least 22 h in the presence or absence of MCSP-positive Colo38 target cells. Briefly, 0.3 million primary human PBMCs were plated per well of a flat-bottom 96-well plate, containing the MCSP-positive target cells (or medium). The final effector to target cell (E:T) ratio was 10:1. The cells were incubated with the indicated concentration of the bispecific constructs and controls for the indicated incubation times at 37° C., 5% $CO_2$. The effector cells were stained for CD8, and CD69 or CD25 and analyzed by FACS CantoII.

Figure 53B:
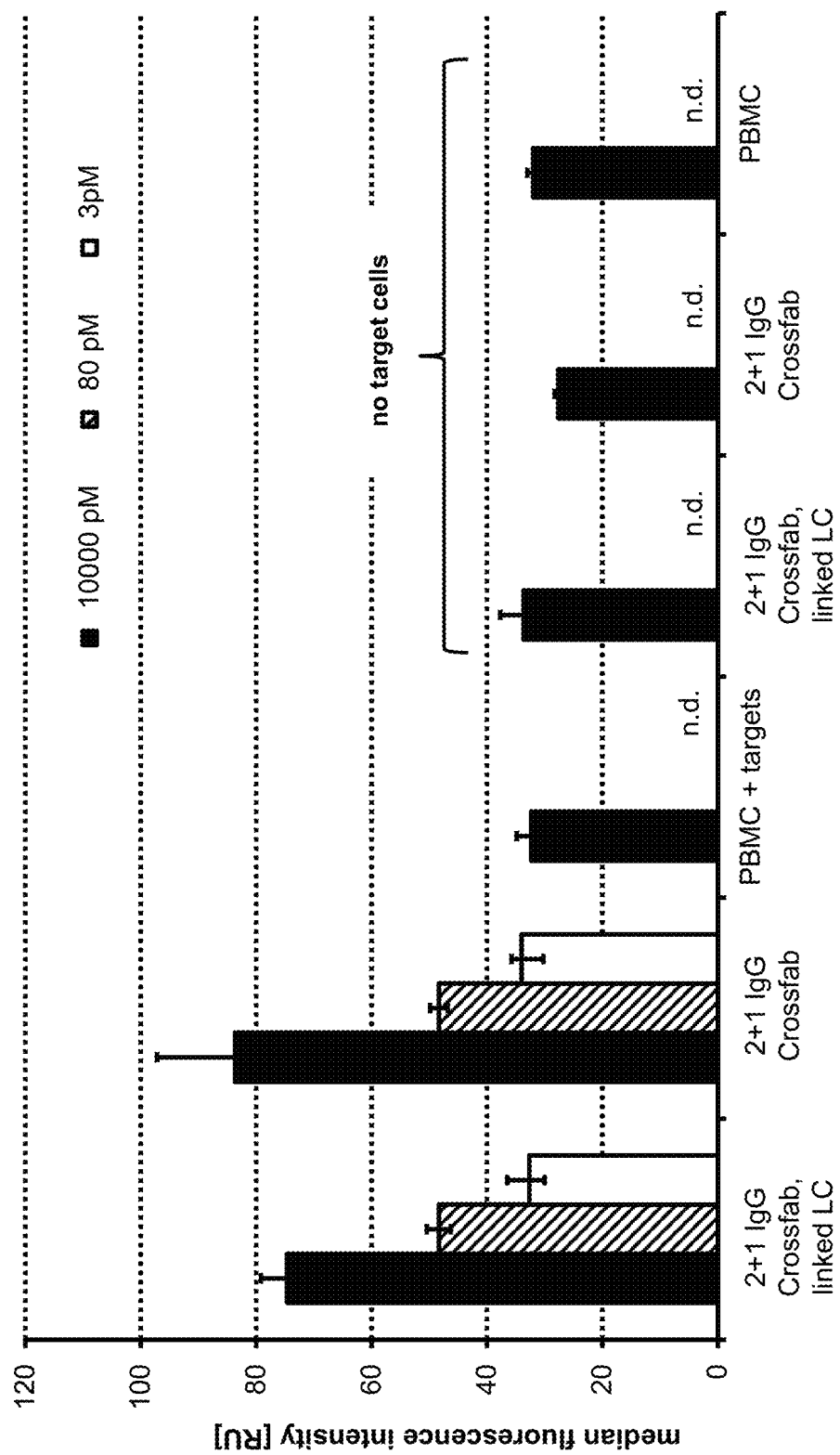
Figure 54A:
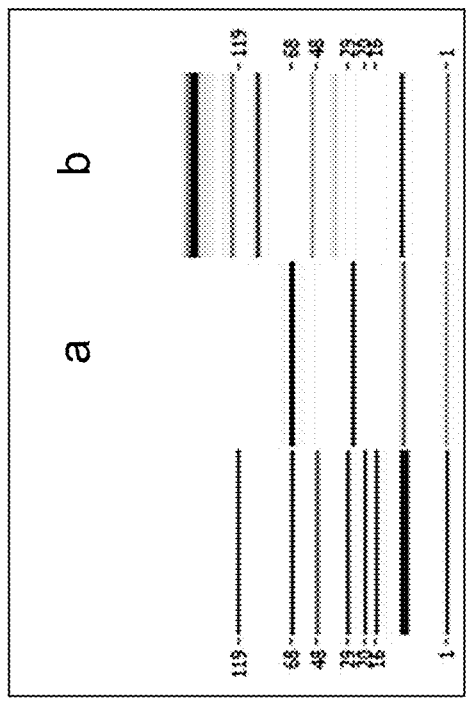
FIGS. 54A-54N. CE-SDS analyses.
Figure 54B:
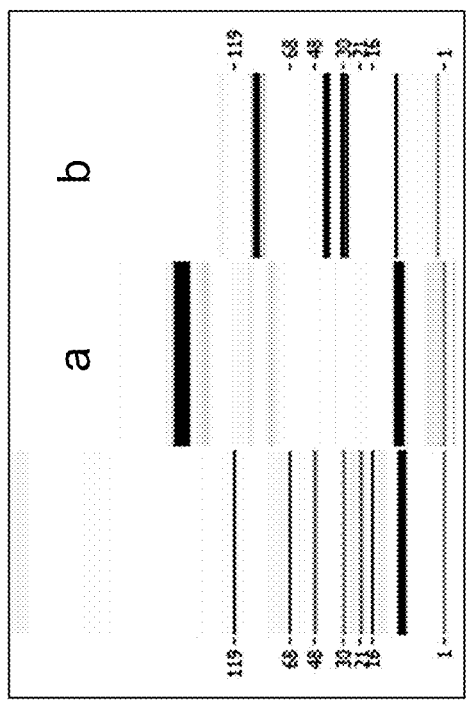
(FIG. 54B) Electropherogram shown as SDS-PAGE of 1+1 CrossMab; CL/CH1 exchange (LC007/V9) (see SEQ ID NOs 5, 23, 183, 185): a) reduced, b) non-reduced.
Figure 54C:
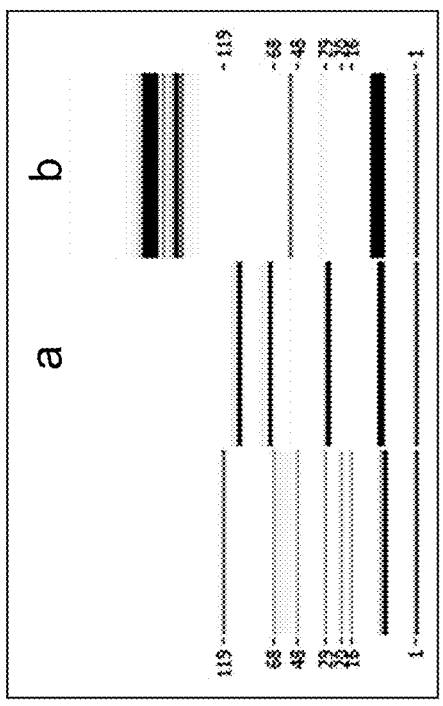
(FIG. 54C) Electropherogram shown as SDS-PAGE of 2+1 IgG Crossfab, inverted; CL/CH1 exchange (LC007/V9) (see SEQ ID NOs 5, 23, 183, 187): a) reduced, b) non-reduced.
Figure 54E:
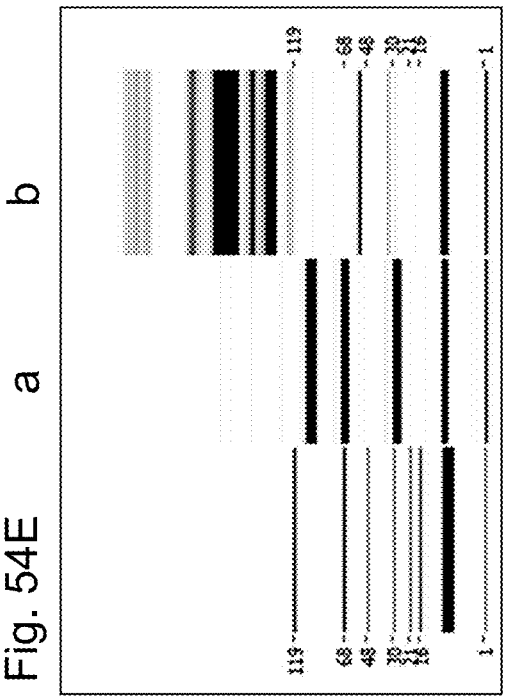
(FIG. 54E) Electropherogram shown as SDS-PAGE of 2+1 IgG Crossfab; CL/CH1 exchange (M4-3 ML2/V9) (see SEQ ID NOs 183, 189, 193, 195): a) reduced, b) non-reduced.
Figure 54D:
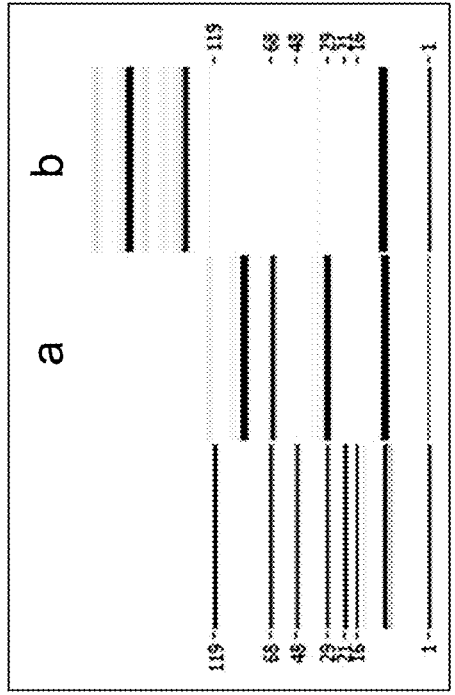
(FIG. 54D) Electropherogram shown as SDS-PAGE of 2+1 IgG Crossfab; VL/VH exchange (M4-3 ML2/V9) (see SEQ ID NOs 33, 189, 191, 193): a) reduced, b) non-reduced.
Figure 54F:
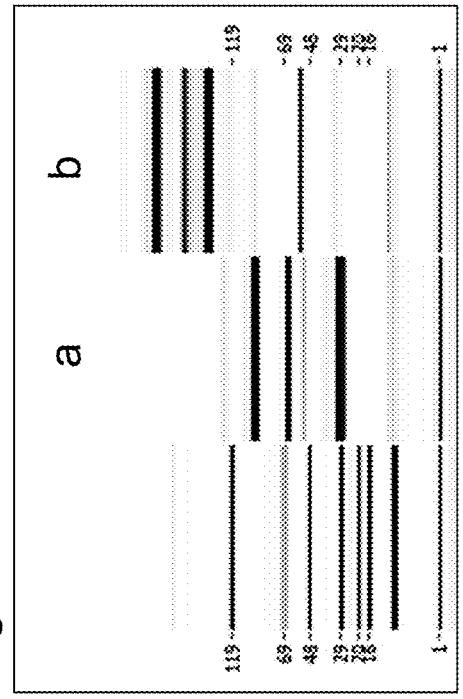
(FIG. 54F) Electropherogram shown as SDS-PAGE of 2+1 IgG Crossfab, inverted; CL/CH1 exchange (CH1A/V9) (see SEQ ID NOs 65, 67, 183, 197): a) reduced, b) non-reduced, (FIG. 54G) Electropherogram shown as SDS-PAGE of 2+1 IgG Crossfab; CL/CH1 exchange (M4-3 ML2/H2C) (see SEQ ID NOs 189, 193, 199, 201): a) reduced, b) non-reduced, (FIG. 54H) Electropherogram shown as SDS-PAGE of 2+1 IgG Crossfab, inverted; CL/CH1 exchange (431/26/V9) (see SEQ ID NOs 183, 203, 205, 207): a) reduced, b) non-reduced.
Figure 54H:
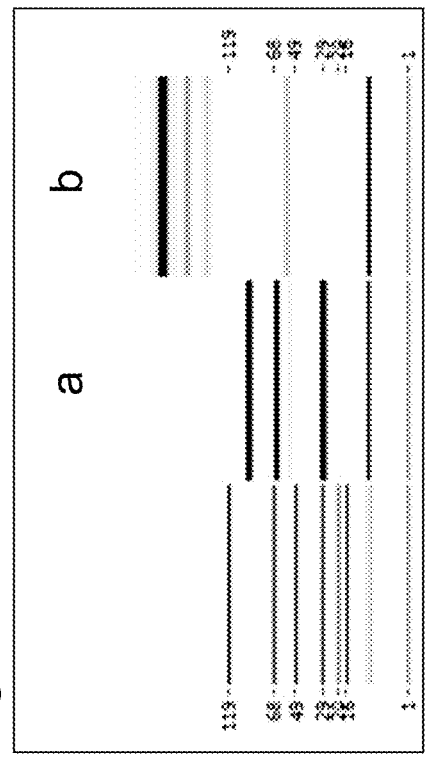
(FIG. 54I) Electropherogram shown as SDS-PAGE of "2+1 IgG Crossfab light chain fusion" (CH1A1A/V9) (see SEQ ID NOs 183, 209, 211, 213): a) reduced, b) non-reduced.
(FIG. 54J) SDS PAGE (4-12% Bis/Tris, NuPage Invitrogen, Coomassie-stained) of "2+1 IgG Crossfab" (anti-MCSP/anti-huCD3) (see SEQ ID NOs 5, 23, 215, 217), non-reduced (left) and reduced (right).
(FIG. 54K) Electropherogram shown as SDS-PAGE of "2+1 IgG Crossfab, inverted" (anti-MCSP/anti-huCD3) (see SEQ ID NOs 5, 23, 215, 219): a) reduced, b) non-reduced.
(FIG. 54L) SDS PAGE (4-12% Bis/Tris, NuPage Invitrogen, Coomassie-stained) of "1+1 IgG Crossfab" (anti-CD33/anti-huCD3) (see SEQ ID NOs 33, 213, 221, 223), reduced (left) and non-reduced (right).
(FIG. 54M) SDS PAGE (4-12% Bis/Tris, NuPage Invitrogen, Coomassie-stained) of "2+1 IgG Crossfab" (anti-CD33/anti-huCD3) (see SEQ ID NOs 33, 221, 223, 225), reduced (left) and non-reduced (right).
Figure 54G:
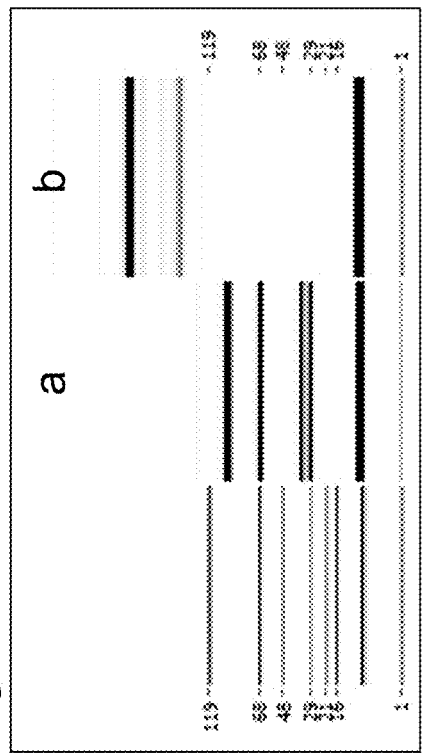
Figure 54I:
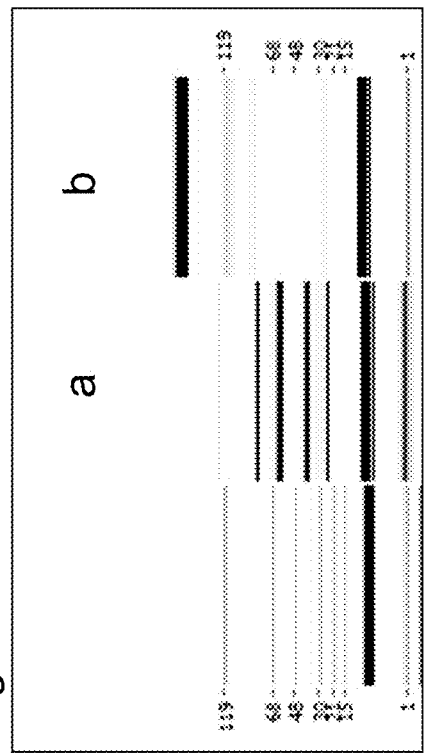
Figure 54K:
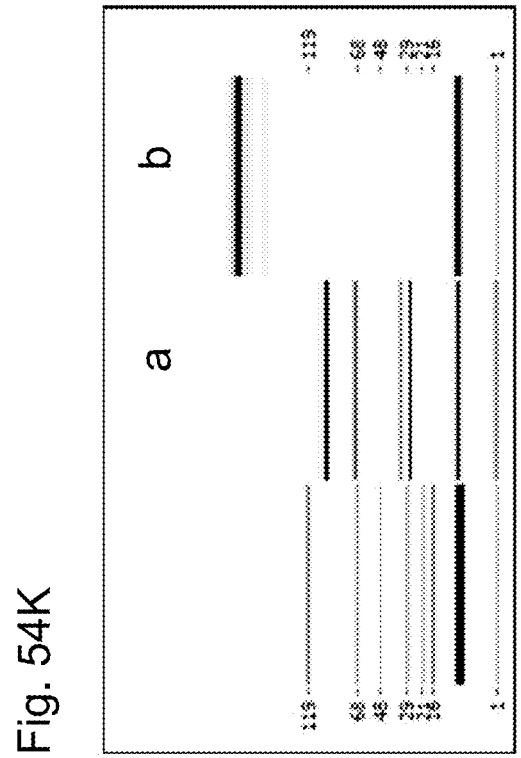
Figure 54J:
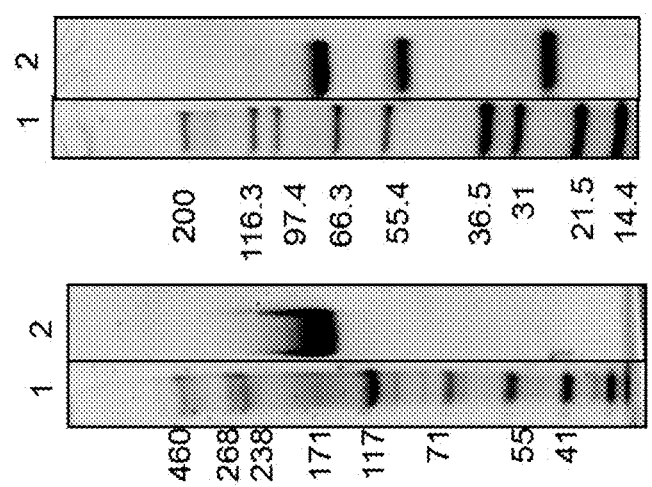
Figure 54M:
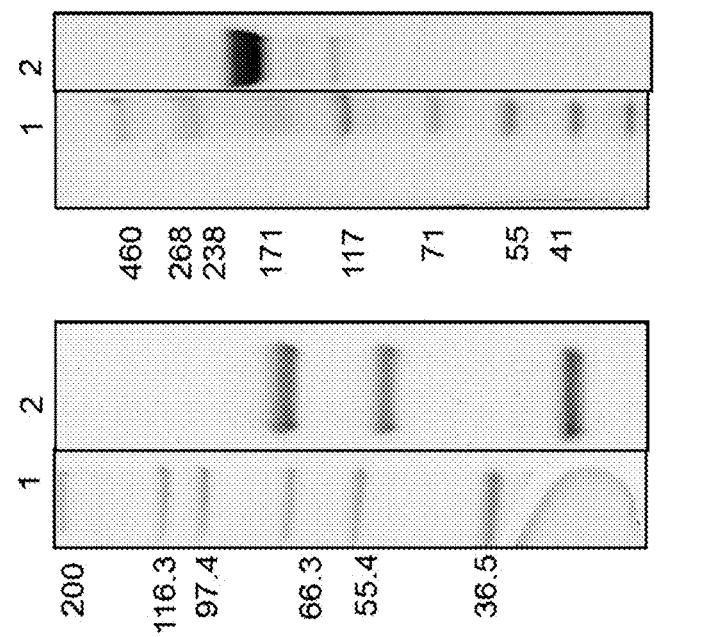
Figure 54L:
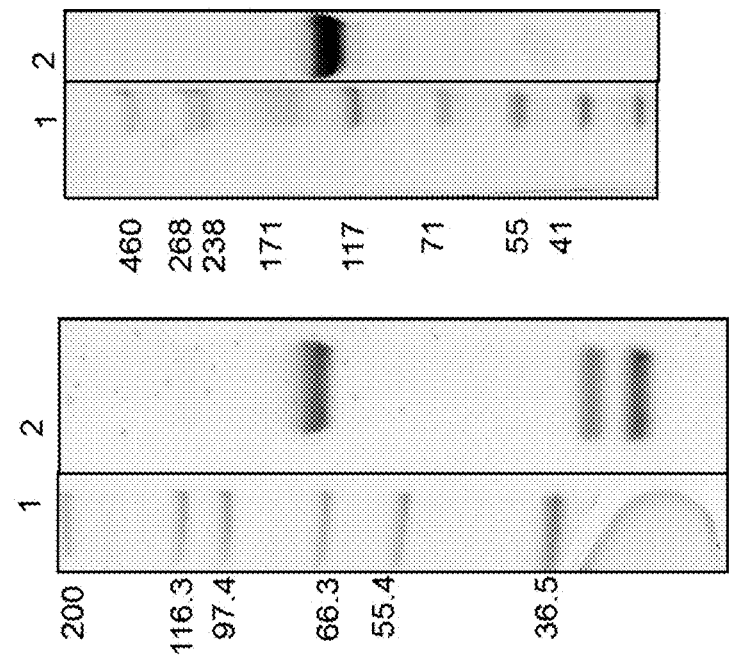
Figure 54N:
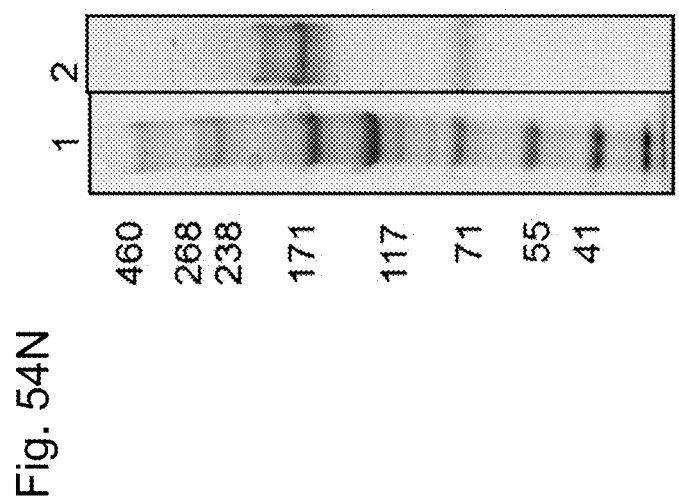

FIG. 53 shows the result of this experiment. There were no significant differences detected for CD69 (A) or CD25 up-regulation (B) between the two 2+1 IgG Crossfab molecules (with or without the linked light chain).

In yet another experiment, the CD3/MCSP "2+1 IgG Crossfab" (see SEQ ID NOs 3, 5, 29, 33) and "1+1 IgG Crossfab" (see SEQ ID NOs 5, 29, 33, 181) constructs were compared to the "1+1 CrossMab" construct (see SEQ ID NOs 5, 23, 183, 185) for their potential to up-regulate CD69 or CD25 on CD4⁺ or CD8⁺ T cells in the presence of tumor target cells. The assay was performed as described above, in the presence of absence of human MCSP expressing MV-3 tumor cells, with an incubation time of 24 h.

As shown in FIG. 59, the "1+1 IgG Crossfab" and "2+1 IgG Crossfab" constructs induced more pronounced upregulation of activation markers than the "1+1 CrossMab" molecule.

In a final experiment, the CD3/MCSP "2+1 IgG Crossfab" (see SEQ ID NOs 5, 23, 215, 217) and "2+1 IgG Crossfab, inverted" (see SEQ ID NOs 5, 23, 215, 219) constructs were assessed for their potential to up-regulate CD25 on CD4⁺ or CD8⁺ T cells from two different cynomolgus monkeys in the presence of tumor target cells. The assay was performed as described above, in the presence of absence of human MCSP expressing MV-3 tumor cells, with an E:T ratio of 3:1 and an incubation time of about 41 h.

Figure 60A:
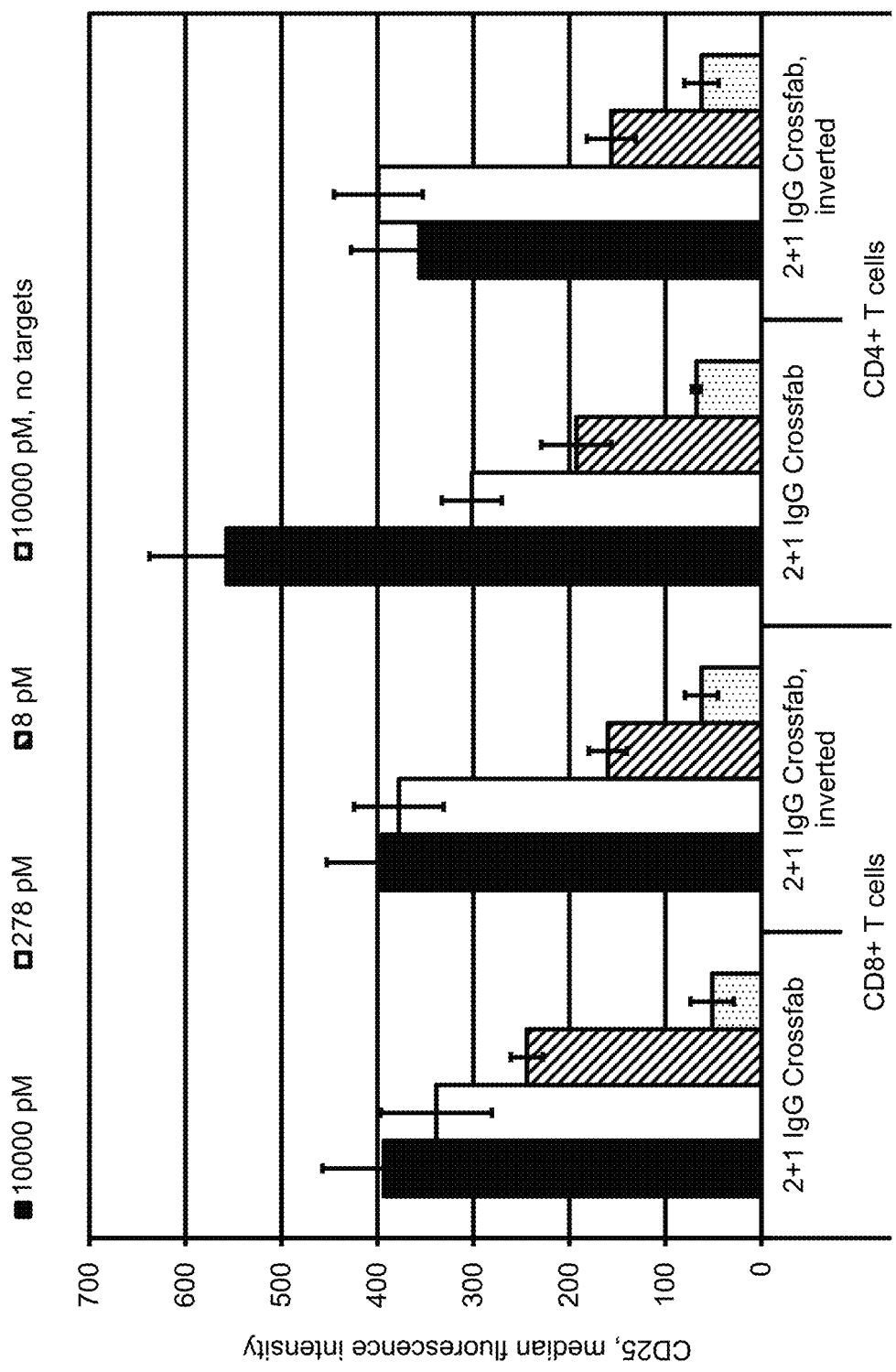

As shown in FIG. 60, both constructs were able to up-regulate CD25 on CD4⁺ and CD8⁺ T cells in a concentration-dependent manner, without significant difference between the two formats. Control samples without antibody and without target cells gave a comparable signal to the samples with antibody but no targets (not shown).

Example 5

Interferon-γ Secretion Upon Activation of Human Pan T Cells with CD3 Bispecific Constructs Purified "2+1 IgG scFab" targeting human MCSP and human CD3 (SEQ ID NOs 5, 17, 19) was analyzed for its potential to induce T cell activation in the presence of human MCSP-positive U-87MG cells, measured by the release of human interferon (IFN)-γ into the supernatant. As controls, anti-human MCSP and anti-human CD3 IgGs were used, adjusted to the same molarity. Briefly, huMCSP-expressing U-87MG glioblastoma astrocytoma target cells (ECACC 89081402) were harvested with Cell Dissociation Buffer, washed and resuspended in AIM-V medium (Invitrogen #12055-091). 20,000 cells per well were plated in a round-bottom 96-well-plate and the respective antibody dilution was added to obtain a final concentration of 1 nM. Human pan T effector cells, isolated from Buffy Coat, were added to obtain a final E:T ratio of 5:1. After an overnight incubation of 18.5 h at 37° C., 5% $CO_2$, the assay plate was centrifuged for 5 min at 350×g and the supernatant was transferred into a fresh 96-well plate. Human IFN-γ levels in the supernatant were measured by ELISA, according to the manufacturer's instructions (BD OptEIA human IFN-γ ELISA Kit II from Becton Dickinson, #550612).

Figure 26:
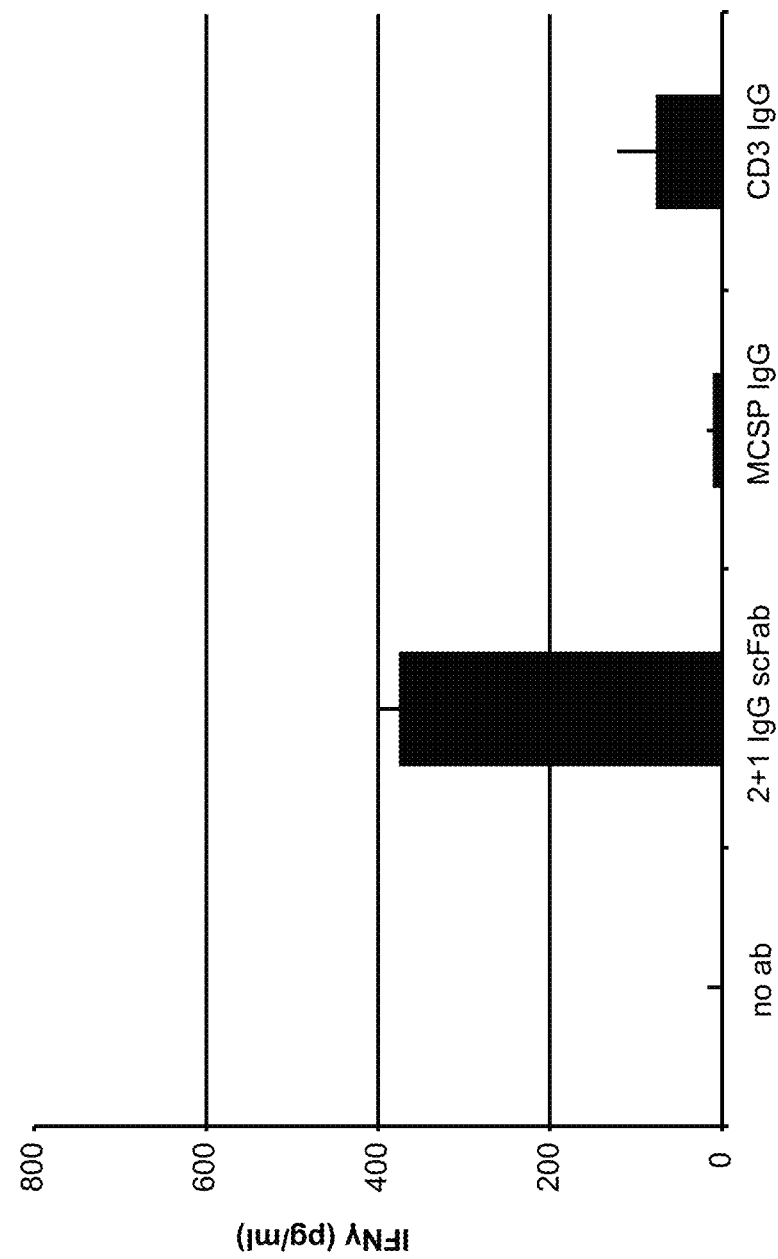
FIG. 26. IFN-γ levels, secreted by human pan T cells that were activated for 18.5 hours by the "2+1 IgG scFab, LALA" CD3-MCSP bispecific construct (see SEQ ID NOs 5, 17, 19) in the presence of U87MG tumor cells (E:T ratio=5:1). As controls, the corresponding anti-CD3 and anti-MCSP IgGs were administered.

As depicted in FIG. 26, the reference IgGs show no to weak induction of IFN-γ secretion, whereas the "2+1 IgG scFab" construct is able to activate human T cells to secrete IFN-γ.

Example 6

Re-directed T Cell Cytotoxicity Mediated by Cross-linked Bispecific Constructs Targeting CD3 on T Cells and MCSP or EGFR on Tumor Cells (LDH Release Assay)

In a first series of experiments, bispecific constructs targeting CD3 and MCSP were analyzed for their potential to induce T cell-mediated apoptosis in tumor target cells upon crosslinkage of the construct via binding of the antigen binding moieties to their respective target antigens on cells (FIGS. 27-38).

In one experiment purified "2+1 IgG scFab" (SEQ ID NOs 5, 21, 23) and "2+1 IgG Crossfab" (SEQ ID NOs 3, 5, 29, 33) constructs targeting human CD3 and human MCSP, and the corresponding "(scFv)$_2$" molecule, were compared. Briefly, huMCSP-expressing MDA-MB-435 human melanoma target cells were harvested with Cell Dissociation Buffer, washed and resuspended in AIM-V medium (Invitrogen #12055-091). 30,000 cells per well were plated in a round-bottom 96-well plate and the respective dilution of the construct was added at the indicated concentration. All constructs and corresponding control IgGs were adjusted to the same molarity. Human pan T effector cells were added to obtain a final E:T ratio of 5:1. As a positive control for the activation of human pan T cells, 1 µg/ml PHA-M (Sigma #L8902; mixture of isolectins isolated from Phaseolus vulgaris) was used. For normalization, maximal lysis of the target cells (=100%) was determined by incubation of the target cells with a final concentration of 1% Triton X-100. Minimal lysis (=0%) refers to target cells co-incubated with effector cells, but without any construct or antibody. After an overnight incubation of 20 h at 37° C., 5% $CO_2$, LDH release of apoptotic/necrotic target cells into the supernatant was measured with the LDH detection kit (Roche Applied Science, #11 644 793 001), according to the manufacturer's instructions.

Figure 27:
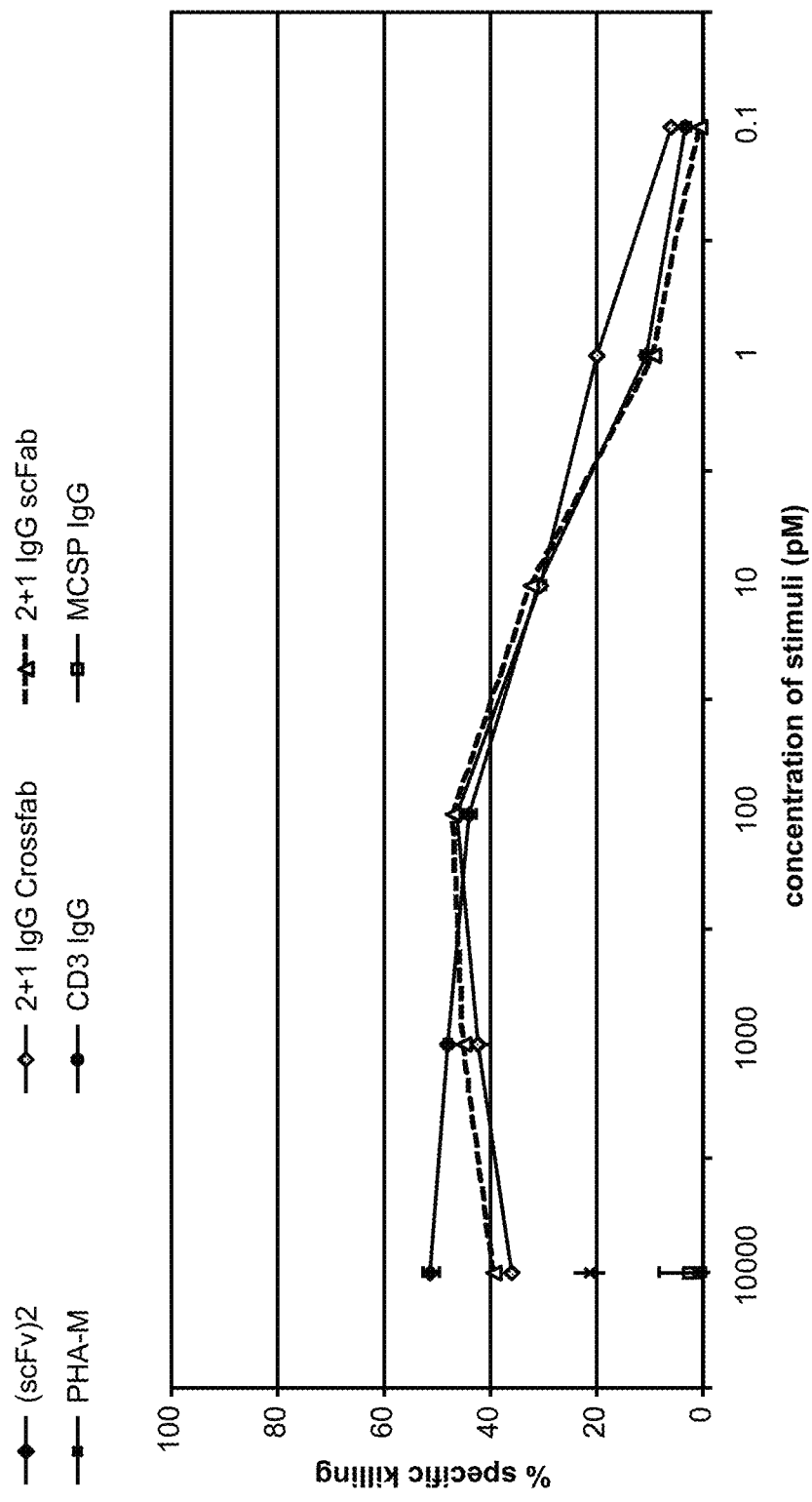
FIG. 27. Killing (as measured by LDH release) of MDA-MB-435 tumor cells upon co-culture with human pan T cells (E:T ratio=5:1) and activation for 20 hours by different concentrations of the "2+1 IgG scFab" (see SEQ ID NOs 5, 21, 23), "2+1 IgG Crossfab" (see SEQ ID NOs 3, 5, 29, 33) and "(scFv)$_2$" bispecific molecules and corresponding IgGs.

As depicted in FIG. 27, both "2+1" constructs induce apoptosis in target cells comparable to the "(scFv)$_2$" molecule.

Further, purified "2+1 IgG Crossfab" (SEQ ID NOs 3, 5, 29, 33) and "2+1 IgG scFab" constructs differing in their Fc domain, as well as the "(scFv)$_2$" molecule, were compared. The different mutations in the Fc domain (L234A+L235A (LALA), P329G and/or N297D, as indicated) reduce or abolish the (NK) effector cell function induced by constructs containing a wild-type (wt) Fc domain.

Experimental procedures were as described above.

Figure 28:
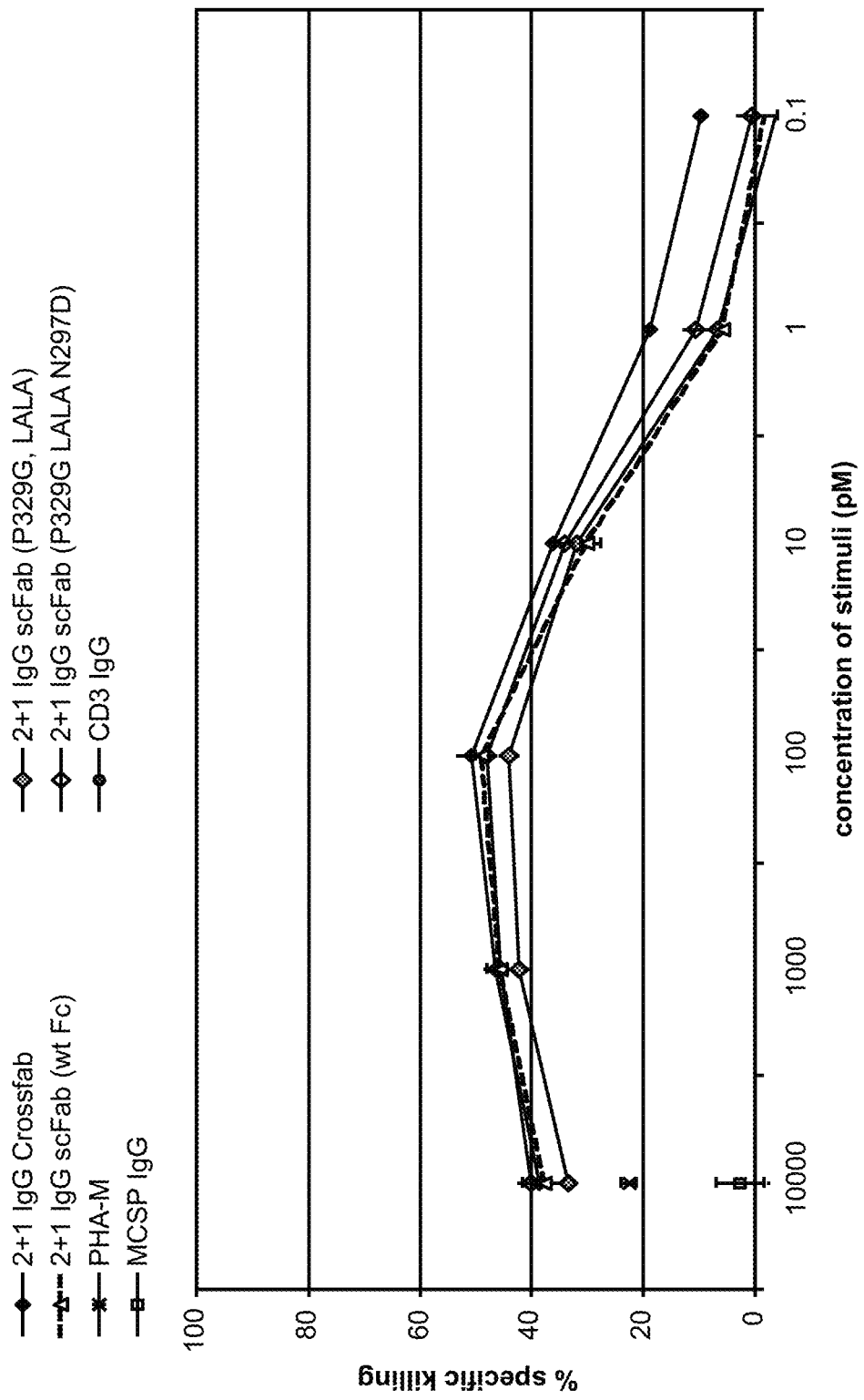
FIG. 28. Killing (as measured by LDH release) of MDA-MB-435 tumor cells upon co-culture with human pan T cells (E:T ratio=5:1), and activation for 20 hours by different concentrations of the bispecific constructs and corresponding IgGs. "2+1 IgG scFab" constructs differing in their Fc-domain (having either a wild-type Fc domain (see SEQ ID NOs 5, 13, 15), or a Fc-domain mutated to abolish (NK) effector cell function: P329G LALA (see SEQ ID NOs 5, 21, 23), P329G LALA N297D (see SEQ ID NOs 5, 25, 27)) and the "2+1 IgG Crossfab" (see SEQ ID NOs 3, 5, 29, 33) construct were compared.

FIG. 28 shows that all constructs induce apoptosis in target cells comparable to the "(scFv)$_2$" molecule.

Figure 29:
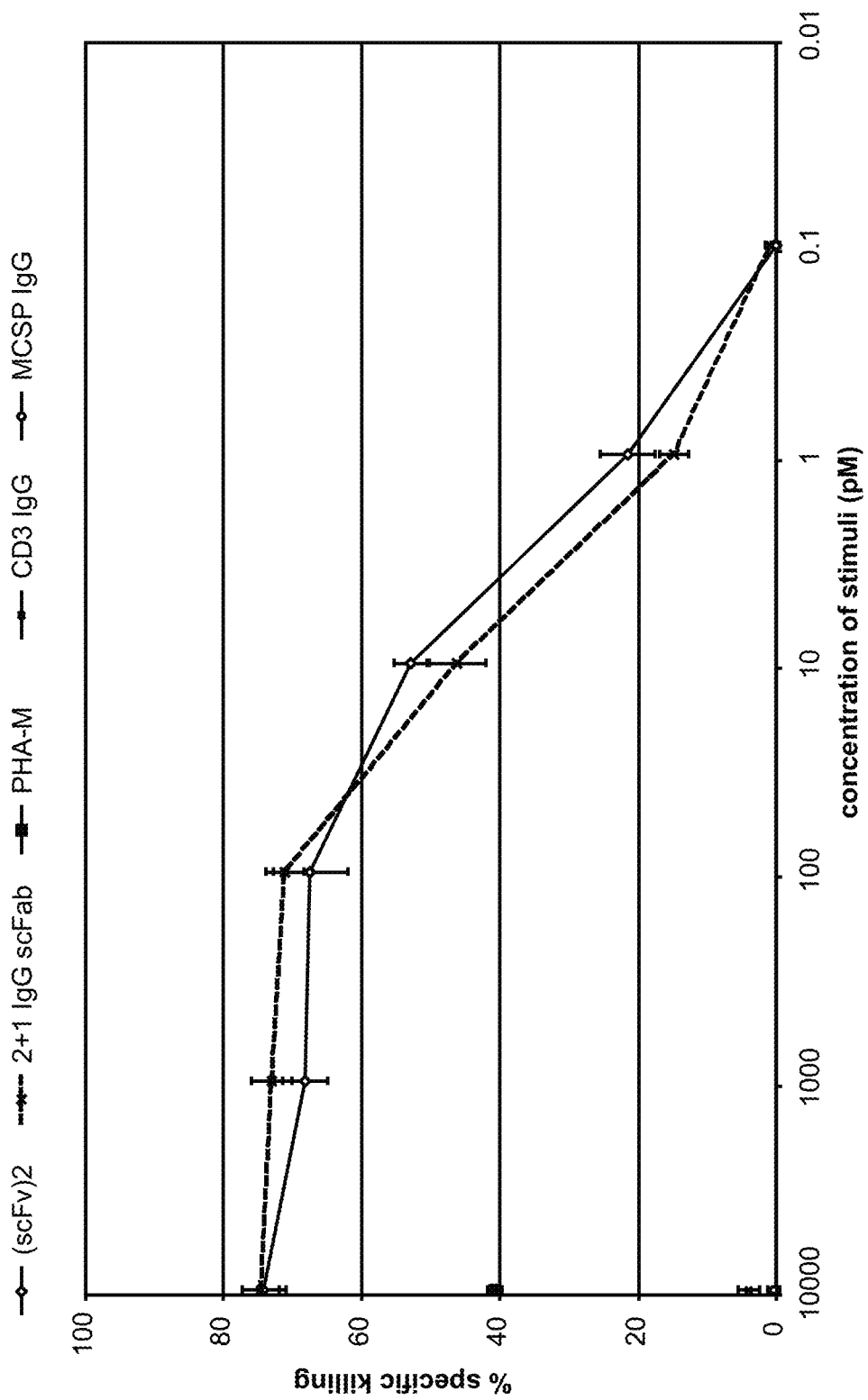
FIG. 29. Killing (as measured by LDH release) of Colo-38 tumor cells upon co-culture with human pan T cells (E:T ratio=5:1), treated with CD3-MCSP bispecific "2+1 IgG scFab, LALA" (see SEQ ID NOs 5, 17, 19) construct, "(scFv)$_2$" molecule or corresponding IgGs for 18.5 hours.

FIG. 29 shows the result of a comparison of the purified "2+1 IgG scFab" (SEQ ID NOs 5, 17, 19) and the "(scFv)$_2$" molecule for their potential to induce T cell-mediated apoptosis in tumor target cells. Experimental procedures were as described above, using huMCSP-expressing Colo-38 human melanoma target cells at an E:T ratio of 5:1, and an overnight incubation of 18.5 h. As depicted in the figure, the "2+1 IgG scFab" construct shows comparable cytotoxic activity to the "(scFv)$_2$" molecule.

Figure 30:
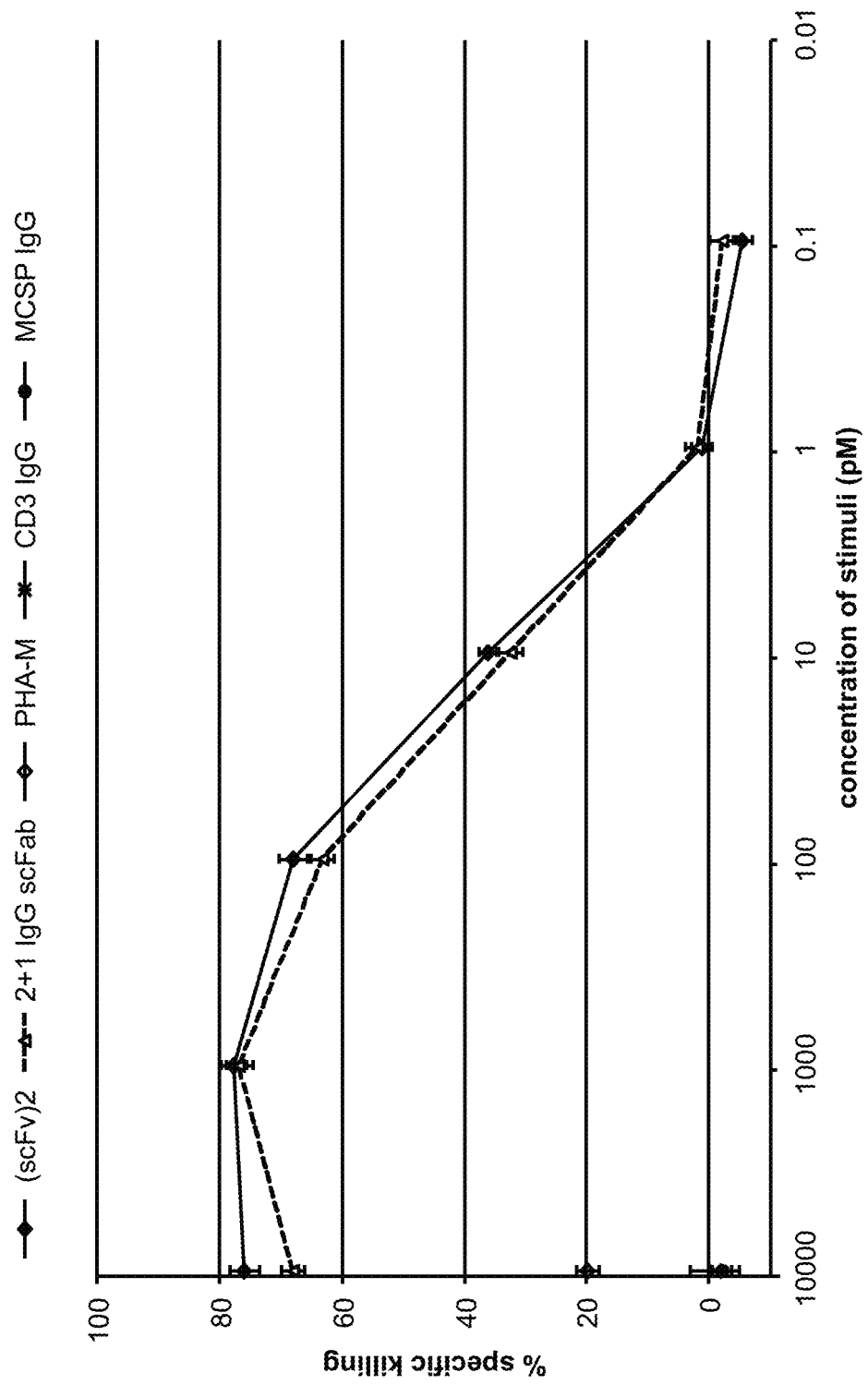
FIG. 30. Killing (as measured by LDH release) of Colo-38 tumor cells upon co-culture with human pan T cells (E:T ratio=5:1), treated with CD3-MCSP bispecific "2±1 IgG scFab, LALA" (see SEQ ID NOs 5, 17, 19) construct, the "(scFv)$_2$" molecule or corresponding IgGs for 18 hours.

Similarly, FIG. 30 shows the result of a comparison of the purified "2+1 IgG scFab" construct (SEQ ID NOs 5, 17, 19) and the "(scFv)$_2$" molecule, using huMCSP-expressing Colo-38 human melanoma target cells at an E:T ratio of 5:1 and an incubation time of 18 h. As depicted in the figure, the "2+1 IgG scFab" construct shows comparable cytotoxic activity to the (scFv)$_2$ molecule.

Figure 31:
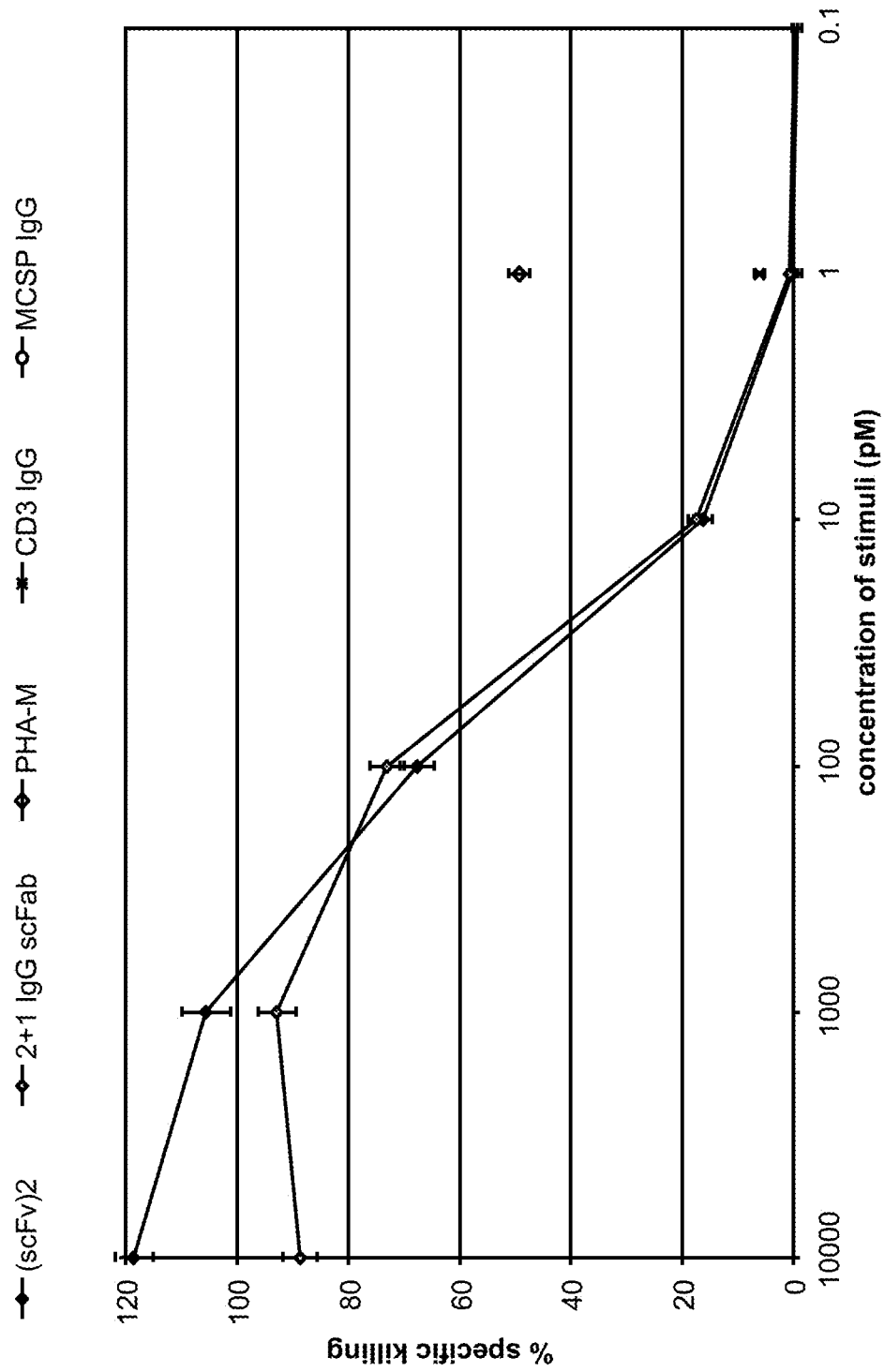
FIG. 31. Killing (as measured by LDH release) of MDA-MB-435 tumor cells upon co-culture with human pan T cells (E:T ratio=5:1), and activation for 23.5 hours by different concentrations of the CD3-MCSP bispecific "2+1 IgG scFab, LALA" (see SEQ ID NOs 5, 17, 19) construct, "(scFv)$_2$" molecule or corresponding IgGs.

FIG. 31 shows the result of a comparison of the purified "2+1 IgG scFab" construct (SEQ ID NOs 5, 17, 19) and the "(scFv)$_2$" molecule, using huMCSP-expressing MDA-MB-435 human melanoma target cells at an E:T ratio of 5:1 and an overnight incubation of 23.5 h. As depicted in the figure, the construct induces apoptosis in target cells comparably to the "(scFv)$_2$" molecule. The "2+1 IgG scFab" construct shows reduced efficacy at the highest concentrations.

Figure 32:
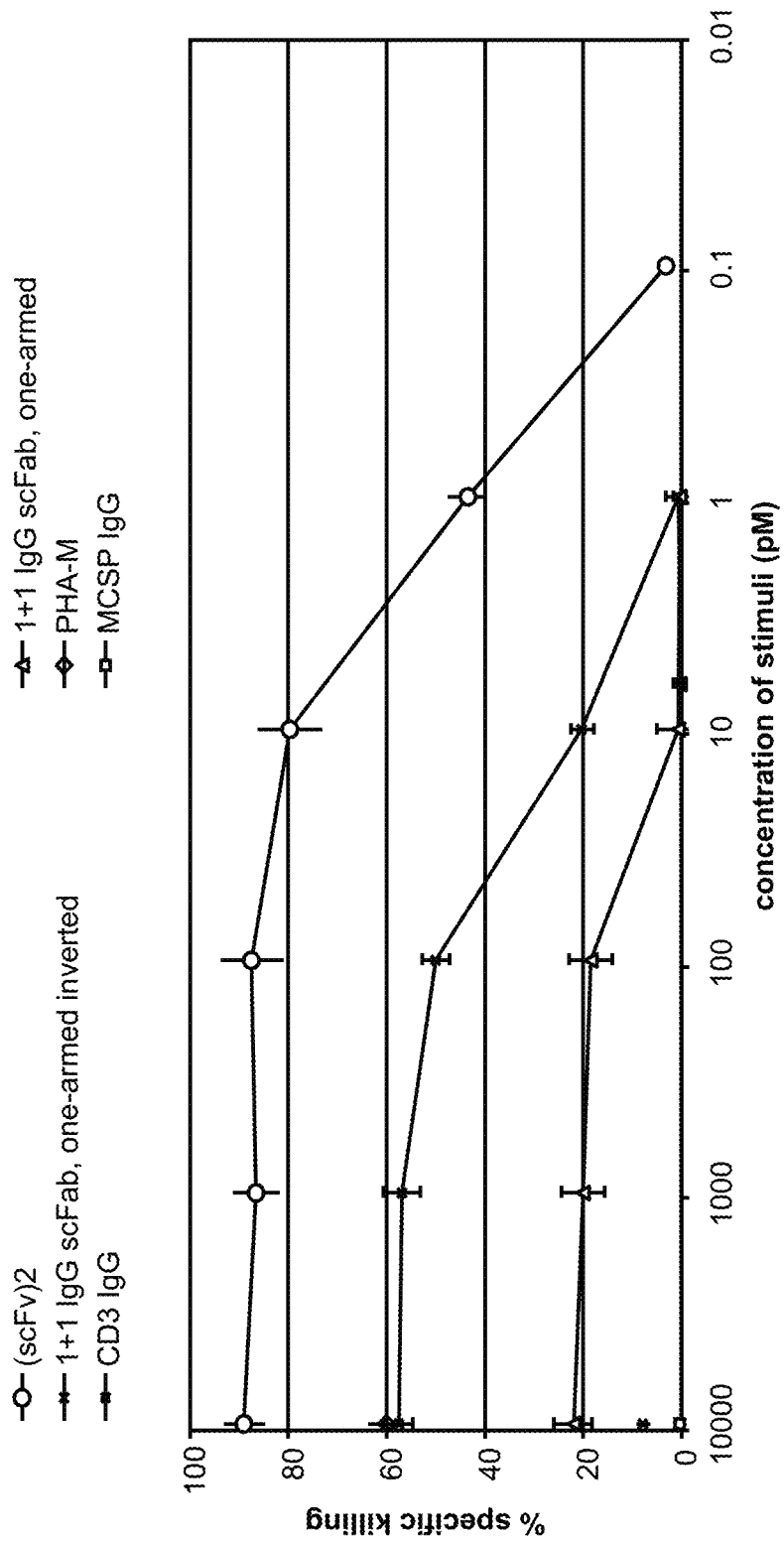
FIG. 32. Killing (as measured by LDH release) of Colo-38 tumor cells upon co-culture with human pan T cells (E:T ratio=5:1) and activation for 19 hours by different concentrations of the CD3-MCSP bispecific "1+1 IgG scFab, one armed" (see SEQ ID NOs 1, 3, 5), "1+1 scFab, one armed inverted" (see SEQ ID NOs 7, 9, 11) or "(scFv)$_2$" constructs, or corresponding IgGs.

Furthermore, different bispecific constructs that are monovalent for both targets, human CD3 and human MCSP, as well as the corresponding "(scFv)$_2$" molecule were analyzed for their potential to induce T cell-mediated apoptosis. FIG. 32 shows the results for the "1+1 IgG scFab, one-armed" (SEQ ID NOs 1, 3, 5) and "1+1 IgG scFab, one-armed inverted" (SEQ ID NOs 7, 9, 11) constructs, using huMCSP-expressing Colo-38 human melanoma target cells at an E:T ratio of 5:1, and an incubation time of 19 h. As depicted in the figure, both "1+1" constructs are less active than the "(scFv)$_2$" molecule, with the "1+1 IgG scFab, one-armed" molecule being superior to the "1+1 IgG scFab, one-armed inverted" molecule in this assay.

Figure 33:
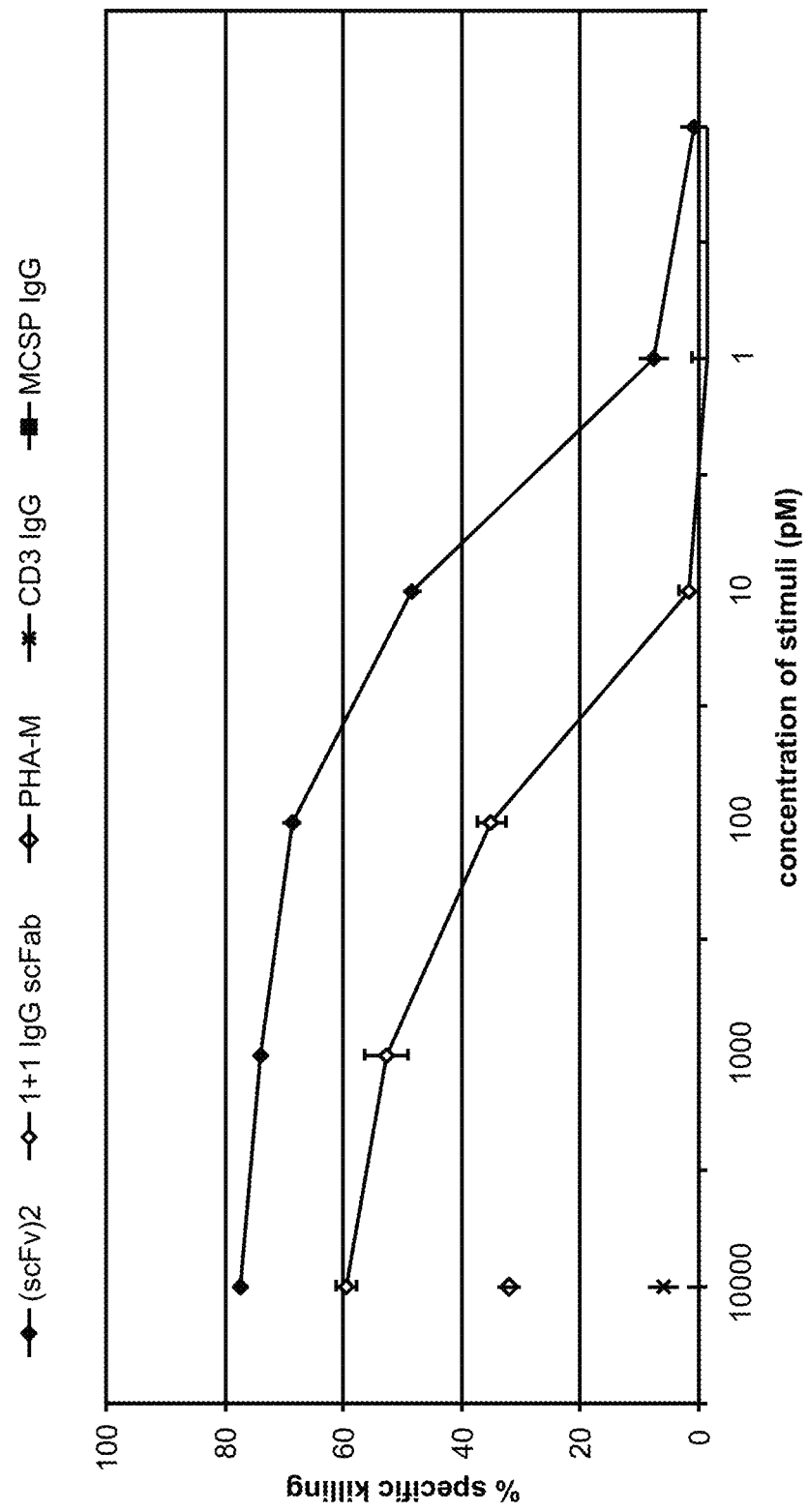
FIG. 33. Killing (as measured by LDH release) of Colo-38 tumor cells upon co-culture with human pan T cells (E:T ratio=5:1), treated with "1+1 IgG scFab" CD3-MCSP bispecific construct (see SEQ ID NOs 5, 21, 213) or "(scFv)$_2$" molecule for 20 hours.

FIG. 33 shows the results for the "1+1 IgG scFab" construct (SEQ ID NOs 5, 21, 213), using huMCSP-expressing Colo-38 human melanoma target cells at an E:T ratio of 5:1, and an incubation time of 20 h. As depicted in the figure, the "1+1 IgG scFab" construct is less cytotoxic than the "(scFv)$_2$" molecule.

Figure 34:
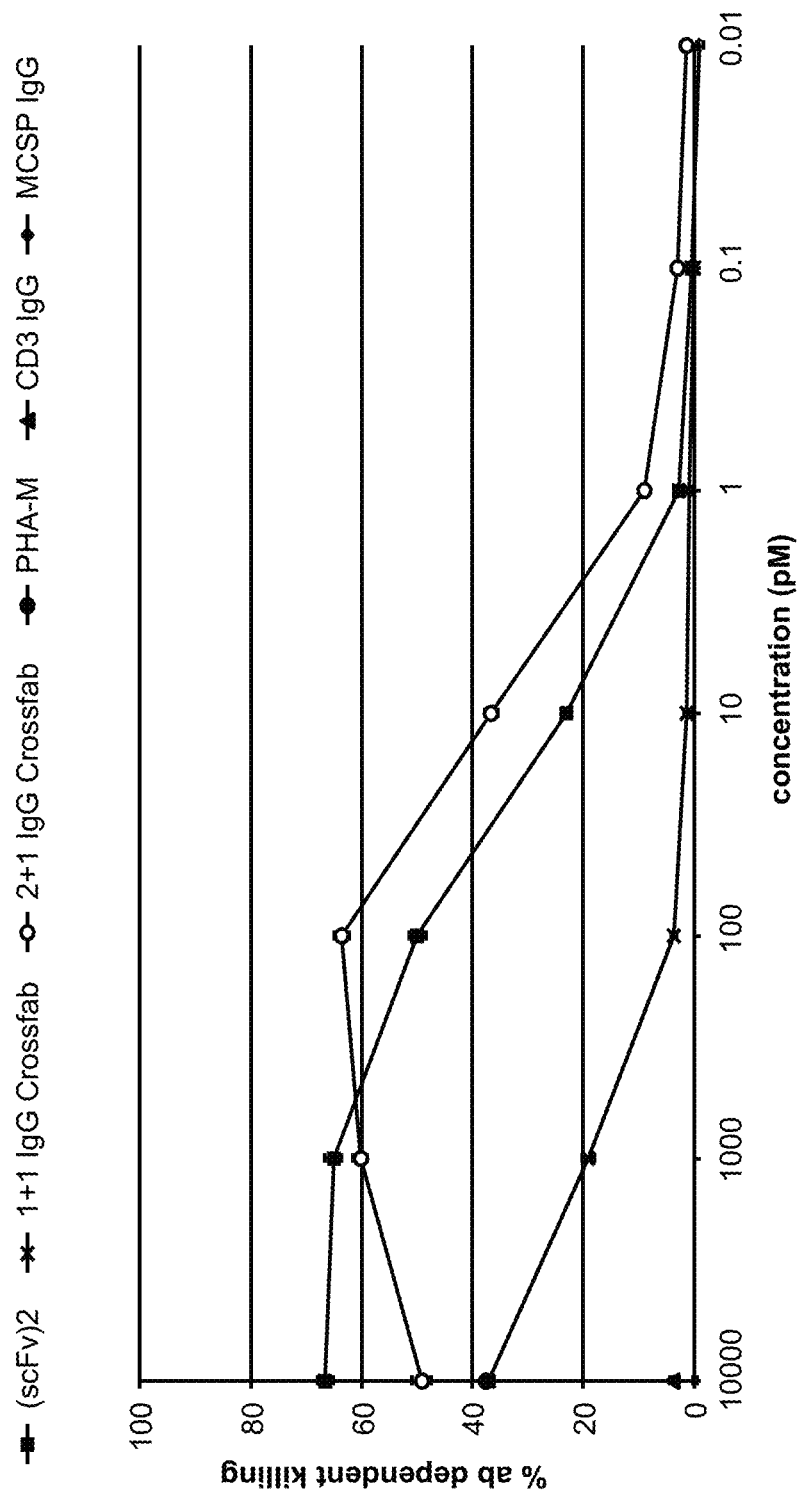
FIG. 34. Killing (as measured by LDH release) of MDA-MB-435 tumor cells upon co-culture with human pan T cells (E:T ratio=5:1), and activation for 21 hours by different concentrations of the bispecific constructs and corresponding IgGs. The CD3-MCSP bispecific "2+1 IgG Crossfab" (see SEQ ID NOs 3, 5, 29, 33) and "1+1 IgG Crossfab" (see SEQ ID NOs 5, 29, 31, 33) constructs, the "(scFv)$_2$" molecule and corresponding IgGs were compared.

In a further experiment the purified "2+1 IgG Crossfab" (SEQ ID NOs 3, 5, 29, 33), the "1+1 IgG Crossfab" (SEQ ID NOs 5, 29, 31, 33) and the "(scFv)$_2$" molecule were analyzed for their potential to induce cell-mediated apoptosis in tumor target cells upon crosslinkage of the construct via binding of both target antigens, CD3 and MCSP, on cells. huMCSP-expressing MDA-MB-435 human melanoma cells were used as target cells, the E:T ratio was 5:1, and the incubation time 20 h. The results are shown in FIG. 34. The "2+1 IgG Crossfab" construct induces apoptosis in target cells comparably to the "(scFv)$_2$" molecule. The comparison of the mono- and bivalent "IgG Crossfab" formats clearly shows that the bivalent one is much more potent.

In yet another experiment, the purified "2+1 IgG Crossfab" (SEQ ID NOs 3, 5, 29, 33) construct was analyzed for its potential to induce T cell-mediated apoptosis in different (tumor) target cells. Briefly, MCSP-positive Colo-38 tumor target cells, mesenchymal stem cells (derived from bone marrow, Lonza #PT-2501 or adipose tissue, Invitrogen #R7788-115) or pericytes (from placenta; PromoCell #C-12980), as indicated, were harvested with Cell Dissociation Buffer, washed and resuspended in AIM-V medium (Invitrogen #12055-091). 30,000 cells per well were plated in a round-bottom 96-well plate and the respective antibody dilution was added at the indicated concentrations. Human PBMC effector cells isolated from fresh blood of a healthy donor were added to obtain a final E:T ratio of 25:1, After an incubation of 4 h at 37° C., 5% $CO_2$, LDH release of apoptotic/necrotic target cells into the supernatant was measured with the LDH detection kit (Roche Applied Science, #11 644 793 001), according to the manufacturer's instructions.

Figure 35:
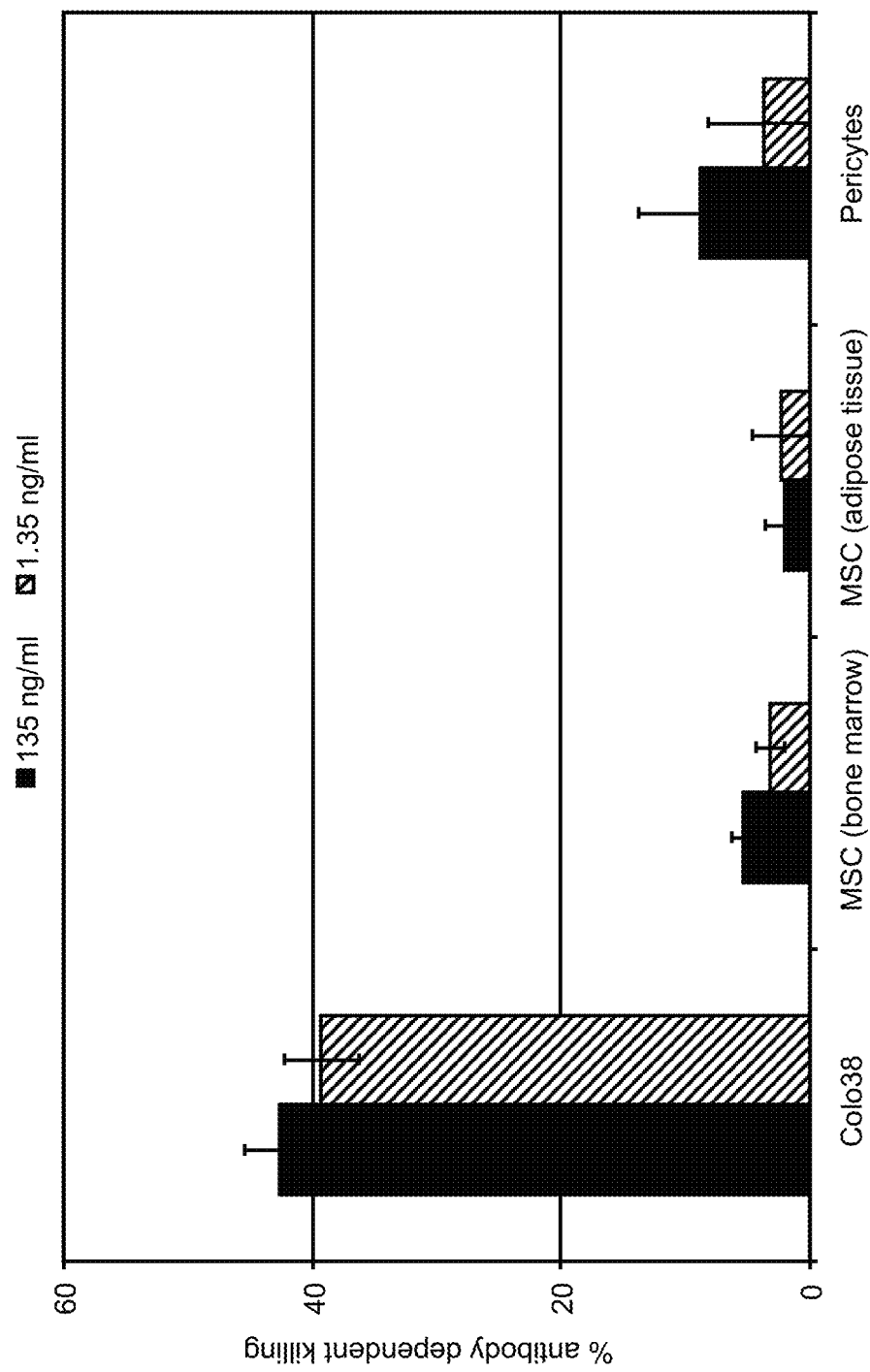
FIG. 35. Killing (as measured by LDH release) of different target cells (MCSP-positive Colo-38 tumor target cells, mesenchymal stem cells derived from bone marrow or adipose tissue, or pericytes from placenta; as indicated) induced by the activation of human T cells by 135 ng/ml or 1.35 ng/ml of the "2+1 IgG Crossfab" CD3-MCSP bispecific construct (see SEQ ID NOs 3, 5, 29, 33) (E:T ratio=25:1).

As depicted in FIG. 35, significant T-cell mediated cytotoxicity could be observed only with Colo-38 cells. This result is in line with Colo-38 cells expressing significant levels of MCSP, whereas mesenchymal stem cells and pericytes express MCSP only very weakly.

Figure 36A:
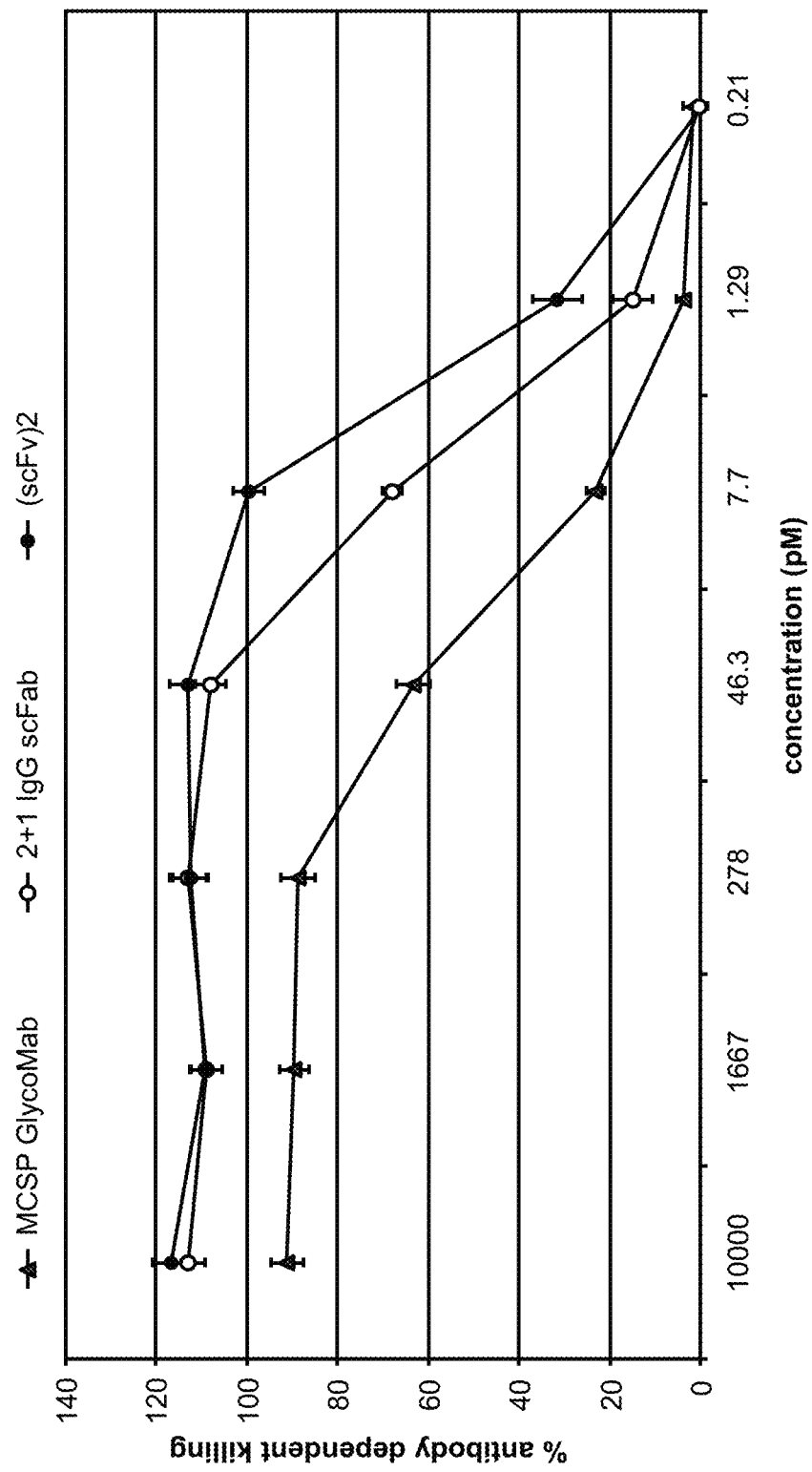
FIGS. 36A and 36B. Killing (as measured by LDH release) of Colo-38 tumor target cells, measured after an overnight incubation of 21 h, upon co-culture with human PBMCs and different CD3-MCSP bispecific constructs ("2+1 IgG scFab, LALA" (see SEQ ID NOs 5, 17, 19) and "(scFv)?") or a glycoengineered anti-MCSP IgG (Glyco-Mab). The effector to target cell ratio was fixed at 25:1 (FIG. 36A), or varied as depicted (FIG. 36B). PBMCs were isolated from fresh blood (FIG. 36A) or from a Buffy Coat (FIG. 36B).
Figure 36B:
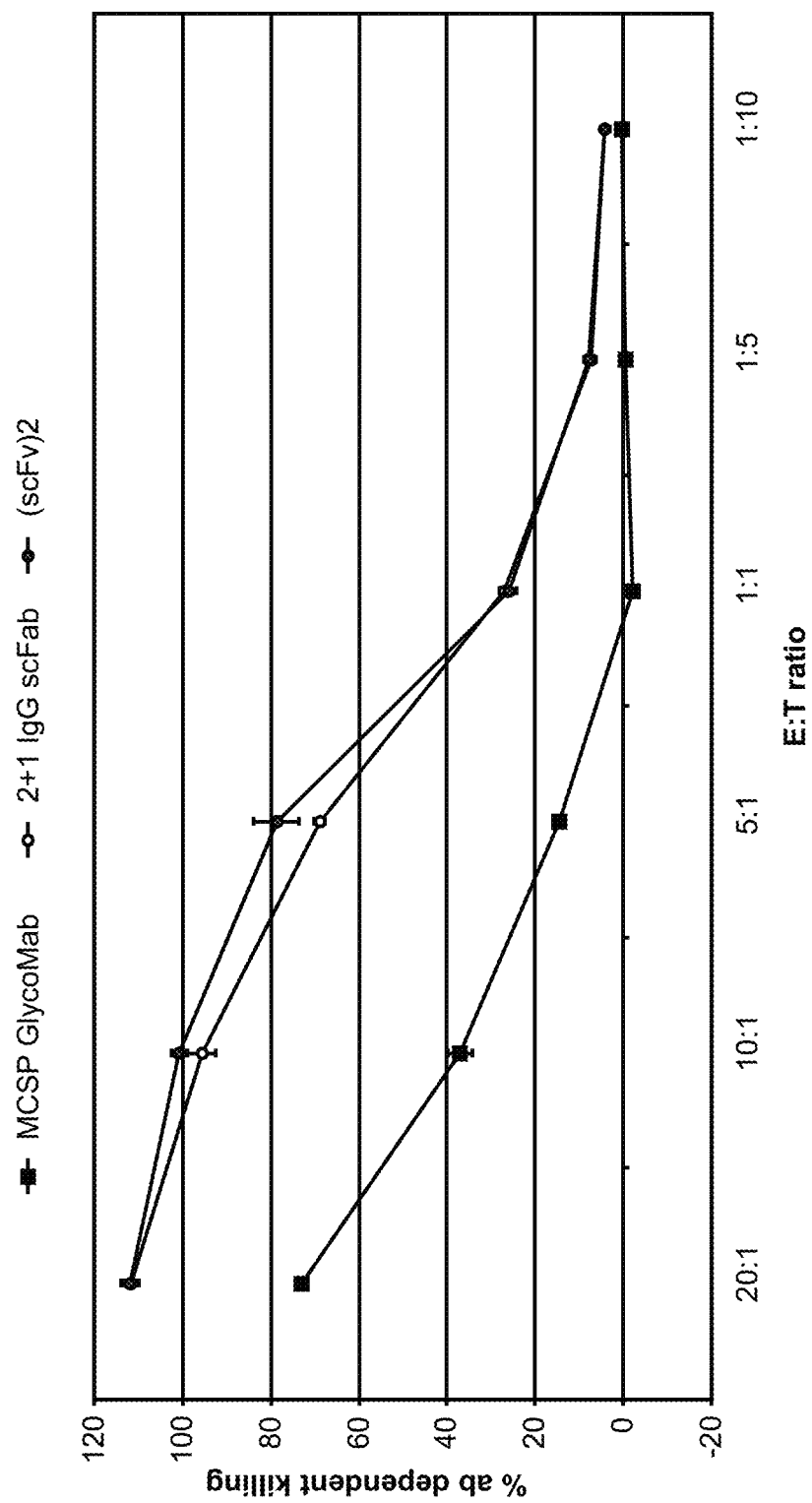

The purified "2+1 IgG scFab" (SEQ ID NOs 5, 17, 19) construct and the "(scFv)$_2$" molecule were also compared to a glycoengineered anti-human MCSP IgG antibody, having a reduced proportion of fucosylated N-glycans in its Fc domain (MCSP GlycoMab). For this experiment huMCSP-expressing Colo-38 human melanoma target cells and human PBMC effector cells were used, either at a fixed E:T ratio of 25:1 (FIG. 36 panel A), or at different E:T ratios from 20:1 to 1:10 (FIG. 36 panel B). The different molecules were used at the concentrations indicated in FIG. 36 panel A, or at a fixed concentration of 1667 pM (FIG. 36 panel B). Read-out was done after 21 h incubation. As depicted in FIG. 36 panels A and B, both bispecific constructs show a higher potency than the MSCP GlycoMab.

In another experiment, purified "2+1 IgG Crossfab" targeting cynomolgus CD3 and human MCSP (SEQ ID NOs 3, 5, 35, 37) was analyzed. Briefly, human MCSP-expressing MV-3 tumor target cells were harvested with Cell Dissociation Buffer, washed and resuspended in DMEM containing 2% FCS and 1% GlutaMax. 30,000 cells per well were plated in a round-bottom 96-well plate and the respective dilution of construct or reference IgG was added at the concentrations indicated. The bispecific construct and the different IgG controls were adjusted to the same molarity. Cynomolgus PBMC effector cells, isolated from blood of healthy cynomolgus, were added to obtain a final E:T ratio of 3:1. After incubation for 24 h or 43 h at 37° C., 5% $CO_2$, LDH release of apoptotic/necrotic target cells into the supernatant was measured with the LDH detection kit (Roche Applied Science, #11 644 793 001), according to the manufacturer's instructions.

Figure 37:
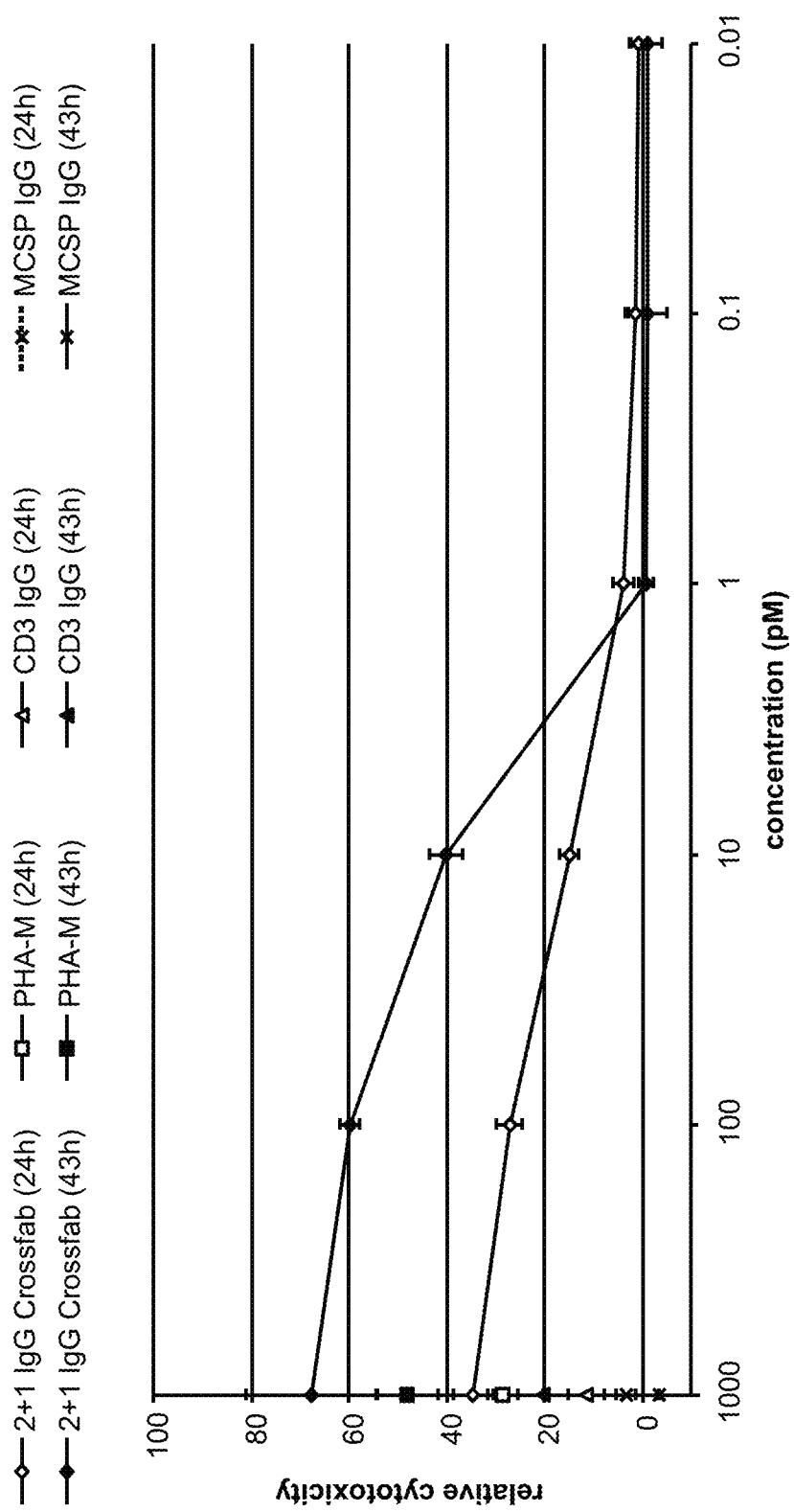
FIG. 37. Time-dependent cytotoxic effect of the "2+1 IgG Crossfab" construct, targeting cynomolgus CD3 and human MCSP (see SEQ ID NOs 3, 5, 35, 37). Depicted is the LDH release from human MCSP-expressing MV-3 cells upon co-culture with primary cynomolgus PBMCs (E:T ratio=3:1) for 24 h or 43 h. As controls, the reference IgGs (anti-cyno CD3 IgG and anti-human MCSP IgG) were used at the same molarity. PHA-M served as a control for (unphysiologic) T cell activation.

As depicted in FIG. 37, the bispecific construct induces concentration-dependent LDH release from target cells. The effect is stronger after 43 h than after 24 h. The anti-cynoCD3 IgG (clone FN-18) is also able to induce LDH release of target cells without being crosslinked.

Figure 38:
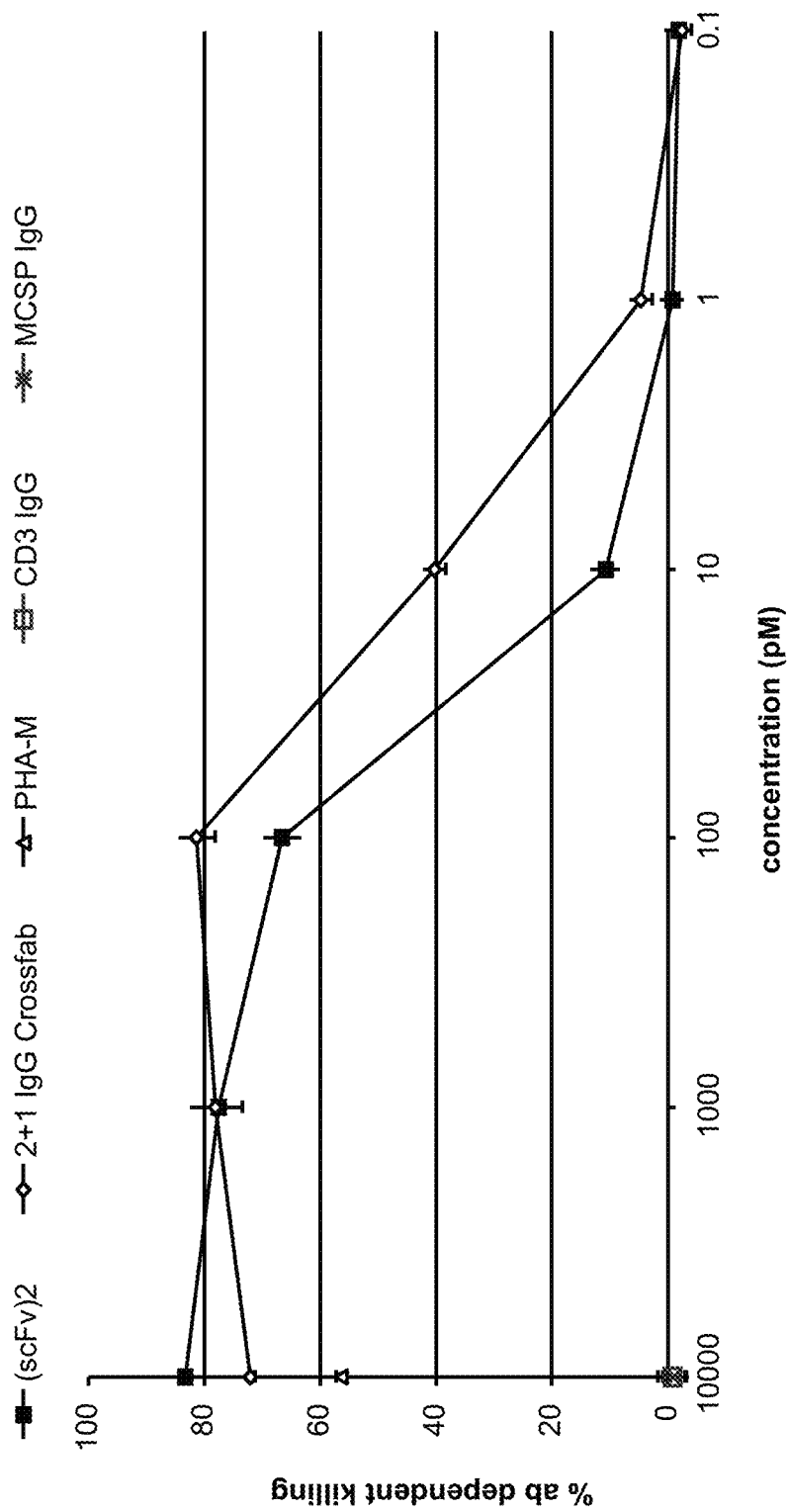
FIG. 38. Killing (as measured by LDH release) of huMCSP-positive MV-3 melanoma cells upon co-culture with human PBMCs (E:T ratio=10:1), treated with different CD3-MCSP bispecific constructs ("2±1 IgG Crossfab" (see SEQ ID NOs 3, 5, 29, 33) and "(scFv)$_2$") for ~26 hours.

FIG. 38 shows the result of a comparison of the purified "2+1 IgG Crossfab" (SEQ NOs 3, 5, 29, 33) and the "(scFv)$_2$" construct, using MCSP-expressing human melanoma cell line (MV-3) as target cells and human PBMCs as effector cells with an E:T ratio of 10:1 and an incubation time of 26 h. As depicted in the figure, the "2+1 IgG Crossfab" construct is more potent in terms of EC50 than the "(scFv)$_2$" molecule.

Figure 39:
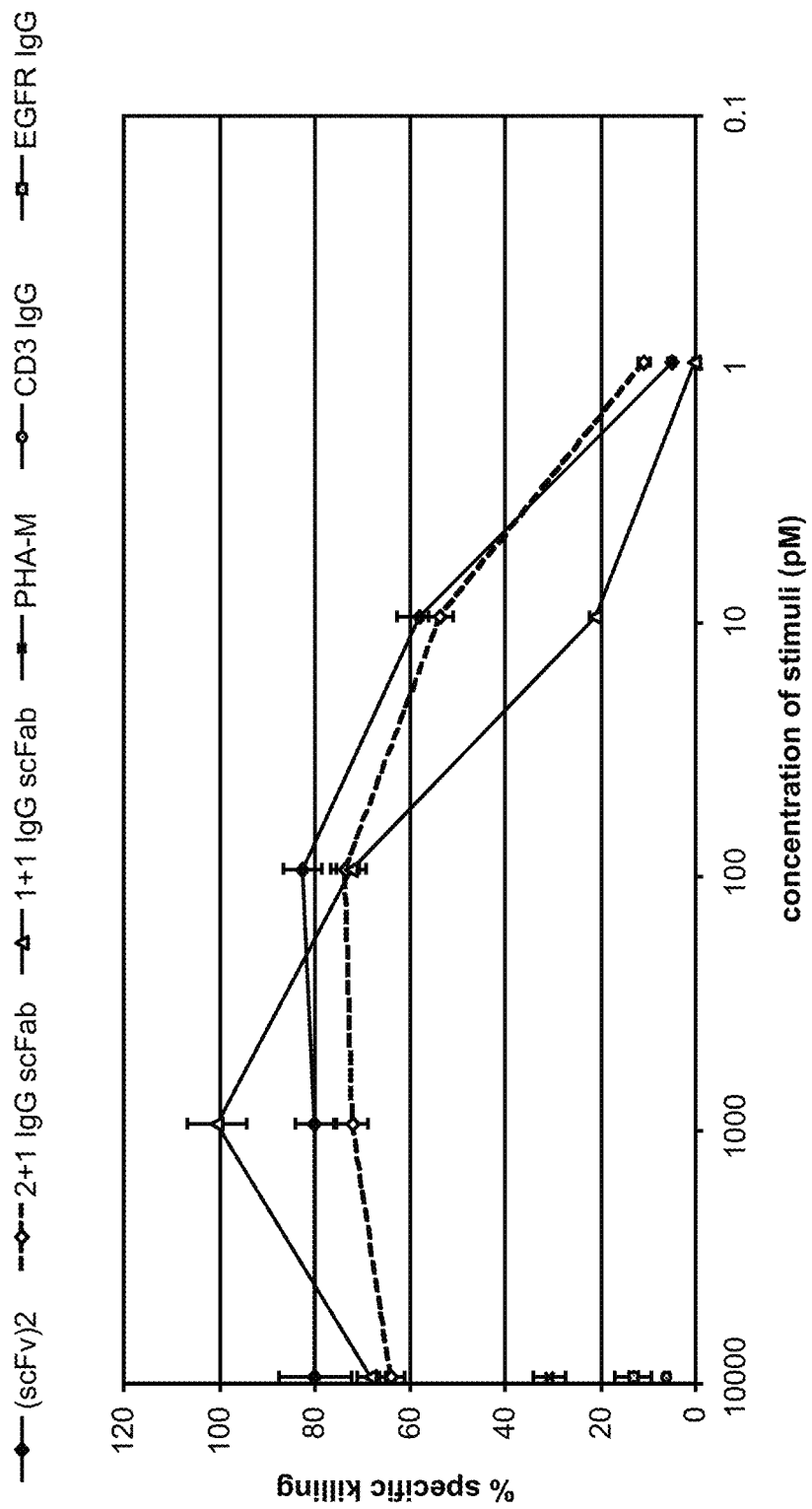
FIG. 39. Killing (as measured by LDH release) of EGFR-positive LS-174T tumor cells upon co-culture with human pan cells (E:T ratio 5:1), treated with different CD3-EGFR bispecific constructs ("2+1 IgG scFab" (see SEQ ID NOs 45, 47, 53), "1+1 IgG scFab" (see SEQ ID NOs 47, 53, 213) and "(scFv)$_2$") or reference IgGs for 18 hours.
Figure 40:
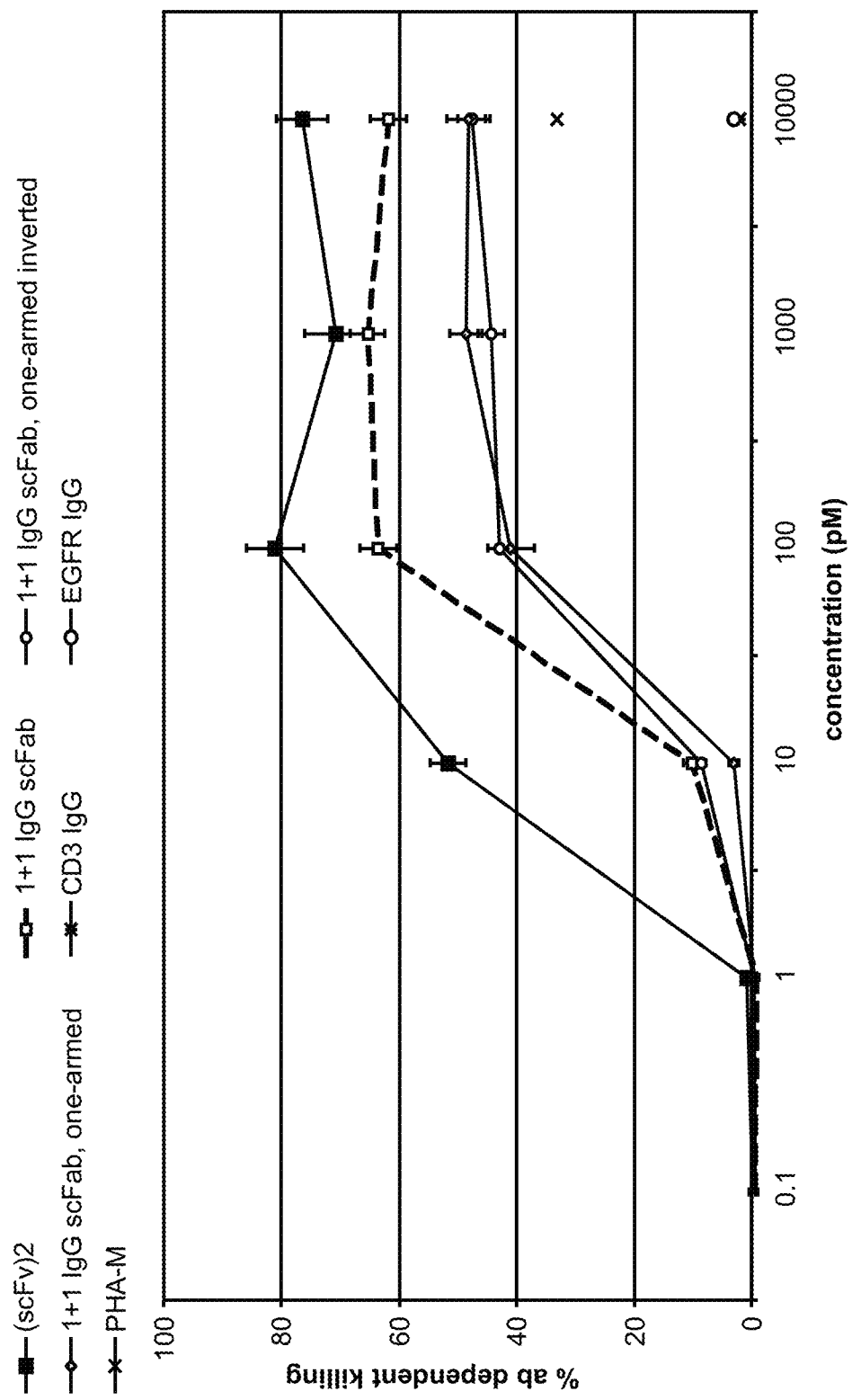
FIG. 40. Killing (as measured by LDH release) of EGFR-positive LS-174T tumor cells upon co-culture with human pan T cells (E:T ratio 5:1), treated with different CD3-EGFR bispecific constructs ("1+1 IgG scFab, one armed" (see SEQ ID NOs 43, 45, 47), "1+1 IgG scFab, one armed inverted" (see SEQ ID NOs 11, 49, 51), "1+1 IgG scFab" (see SEQ ID NOs 47, 53, 213) and "(scFv)$_2$") or reference IgGs for 21 hours.
Figure 41A:
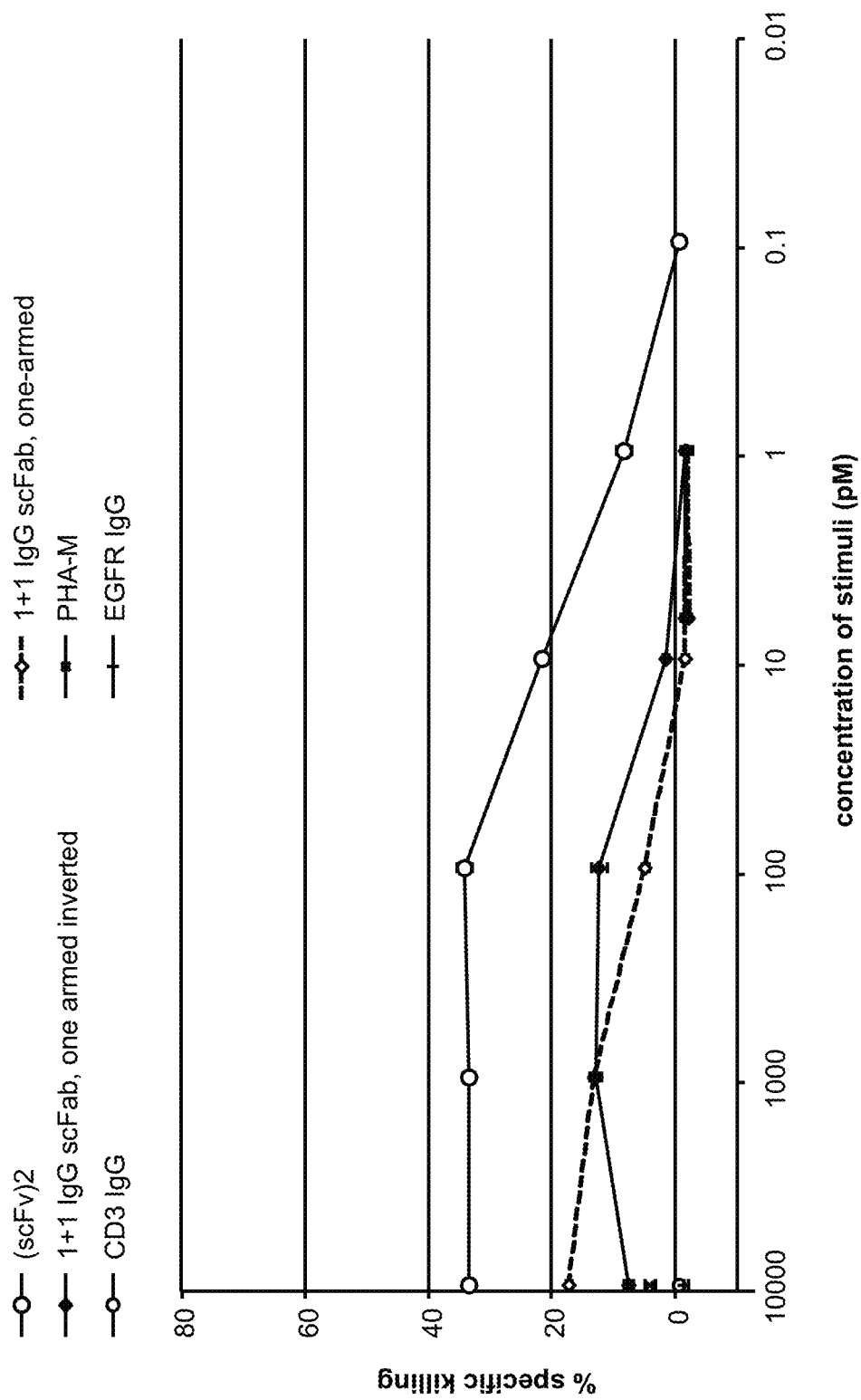
FIGS. 41A and 41B. Killing (as measured by LDH release) of EGFR-positive LS-174T tumor cells upon co-culture with either human pan 1 cells (FIG. 41A) or human naive T cells (FIG. 41B), treated with different CD3-EGFR bispecific constructs ("1+1 IgG scFab, one armed" (see SEQ ID NOs 43, 45, 47), "1+1 IgG scFab, one aimed inverted" (see SEQ ID NOs 11, 49, 51) and "(scFv)$_2$") or reference IgGs for 16 hours. The effector to target cell ratio was 5:1.
Figure 41B:
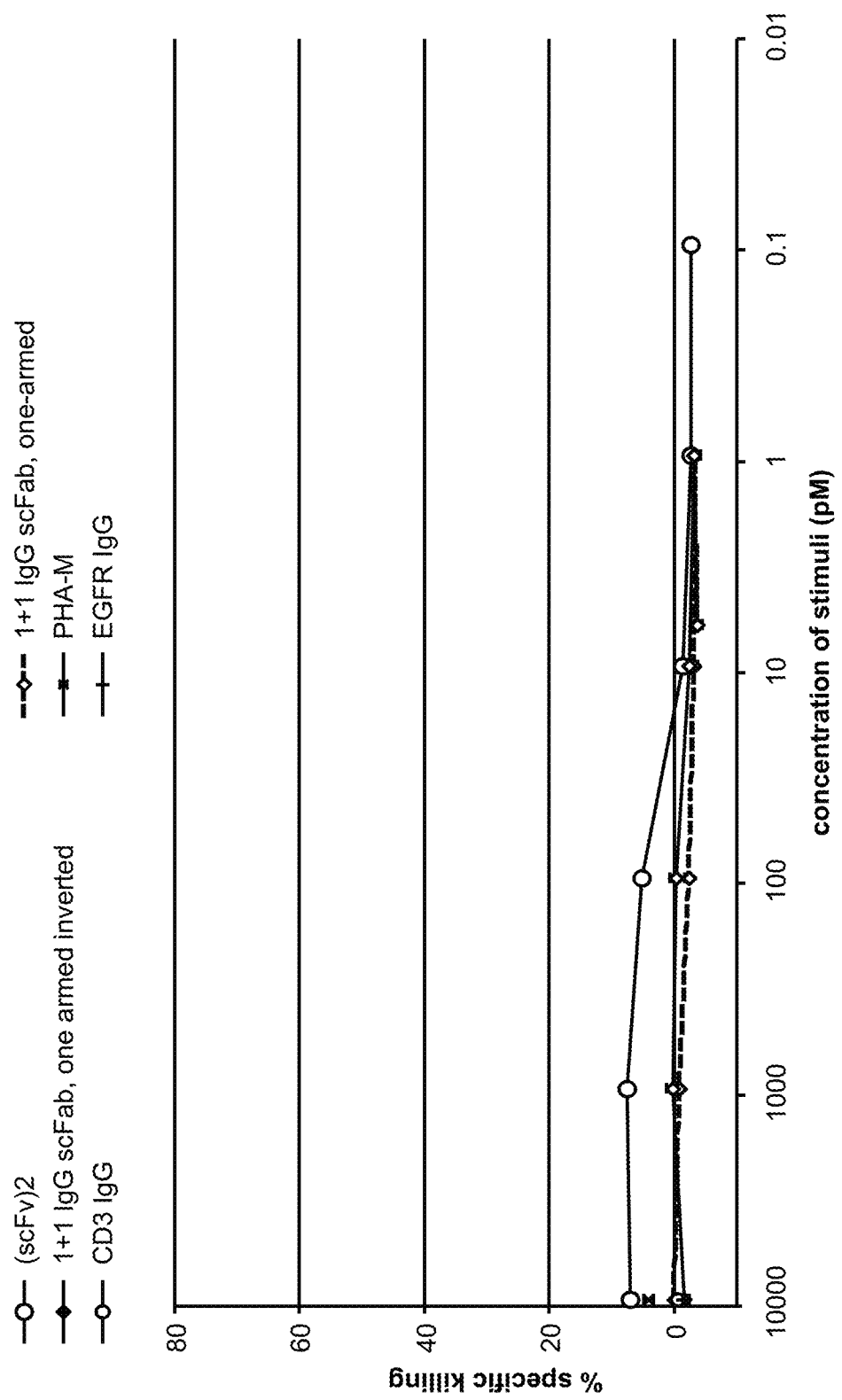

In a second series of experiments, bispecific constructs targeting CD3 and EGFR were analyzed for their potential to induce T cell-mediated apoptosis in tumor target cells upon crosslinkage of the construct via binding of the antigen binding moieties to their respective target antigens on cells (FIGS. 39-41).

In one experiment purified "2+1 IgG scFab" (SEQ ID NOs 45, 47, 53) and "1+1 IgG scFab" (SEQ ID NOs 47, 53, 213) constructs targeting CD3 and EGFR, and the corresponding "(scFv)$_2$" molecule, were compared. Briefly, human EGFR-expressing LS-1741 tumor target cells were harvested with trypsin, washed and resuspended in AIM-V medium (Invitrogen #12055-091). 30,000 cells per well were plated in a round-bottom 96-well-plate and the respective antibody dilution was added at the indicated concentrations. All constructs and controls were adjusted to the same molarity. Human pan T effector cells were added to obtain a final E:T ratio of 5:1. As a positive control for the activation of human pan T cells, 1 µg/ml PHA-M (Sigma #L8902) was used. For normalization, maximal lysis of the target cells (=100%) was determined by incubation of the target cells with a final concentration of 1% Triton X-100. Minimal lysis (=0%) refers to target cells co-incubated with effector cells, but without any construct or antibody. After an overnight incubation of 18 h at 37° C., 5% $CO_2$, LDH release of apoptotic/necrotic target cells into the supernatant was measured with the LDH detection kit (Roche Applied Science, #11 644 793 001), according to the manufacturer's instructions.

As depicted in FIG. 39, the "2+1 IgG scFab" construct shows comparable cytotoxic activity to the "(scFv)$_2$" molecule, whereas the "1+1 IgG scFab" construct is less active.

In another experiment the purified "1+1 IgG scFab, one-armed" (SEQ ID NOs 43, 45, 47), "1+1 IgG scFab, one-armed inverted" (SEQ ID NOs 11, 49, 51), "1+1 IgG scFab" (SEQ ID NOs 47, 53, 213), and the "(scFv)$_2$" molecule were compared. Experimental conditions were as described above, except for the incubation time which was 21 h.

As depicted in FIG. 40, the "1+1 IgG scFab" construct shows a slightly lower cytotoxic activity than the "(scFv)$_2$" molecule in this assay. Both "1+1 IgG scFab, one-armed (inverted)" constructs are clearly less active than the "(scFv)$_2$" molecule.

In yet a further experiment the purified "1+1 IgG scFab, one-armed" (SEQ ID NO 43, 45, 47) and "1+1 IgG scFab, one-armed inverted" (SEQ ID NOs 11, 49, 51) constructs and the "(scFv)$_2$" molecule were compared. The incubation time in this experiment was 16 h, and the result is depicted in FIG. 41. Incubated with human pan T cells, both "1+1 IgG scFab, one-armed (inverted)" constructs are less active than the "(scFv)$_2$" molecule, but show concentration-dependent release of LDH from target cells (FIG. 41 panel A). Upon co-cultivation of the LS-174T tumor cells with naive T cells isolated from PBMCs, the constructs had only a basal activity—the most active among them being the "(scFv)$_2$" molecule (FIG. 41 panel B).

In a further experiment, purified "1+1 IgG scFab, one-armed inverted" (SEQ ID NOs 11, 51, 55), "1+1 IgG scFab" (57, 61, 213), and "2+1 IgG scFab" (57, 59, 61) targeting CD3 and Fibroblast Activation Protein (FAP), and the corresponding "(scFv)$_2$" molecule were analyzed for their potential to induce T cell-mediated apoptosis in human FAP-expressing fibroblasts GM05389 cells upon crosslinkage of the construct via binding of both targeting moieties to their respective target antigens on the cells. Briefly, human GM05389 target cells were harvested with trypsin on the day before, washed and resuspended in AIM-V medium (Invitrogen #12055-091). 30,000 cells per well were plated in a round-bottom 96-well plate and incubated overnight at 37°

C., 5% $CO_2$ to allow the cells to recover and adhere. The next day, the cells were centrifuged, the supernatant was discarded and fresh medium, as well as the respective dilution of the constructs or reference IgGs was added at the indicated concentrations. All constructs and controls were adjusted to the same molarity. Human pan T effector cells were added to obtain a final ET ratio of 5:1. As a positive control for the activation of human pan T cells, 5 µg/ml PHA-M (Sigma #L8902) was used. For normalization, maximal lysis of the target cells (=100%) was determined by incubation of the target cells with a final concentration of 1% Triton X-100. Minimal lysis (=0%) refers to target cells co-incubated with effector cells, but without any construct or antibody. After an additional overnight incubation of 18 h at 37° C., 5% $CO_2$, LDH release of apoptotic/necrotic target cells into the supernatant was measured with the LDH detection kit (Roche Applied Science, #11 644 793 001), according to the manufacturer's instructions.

Figure 42:
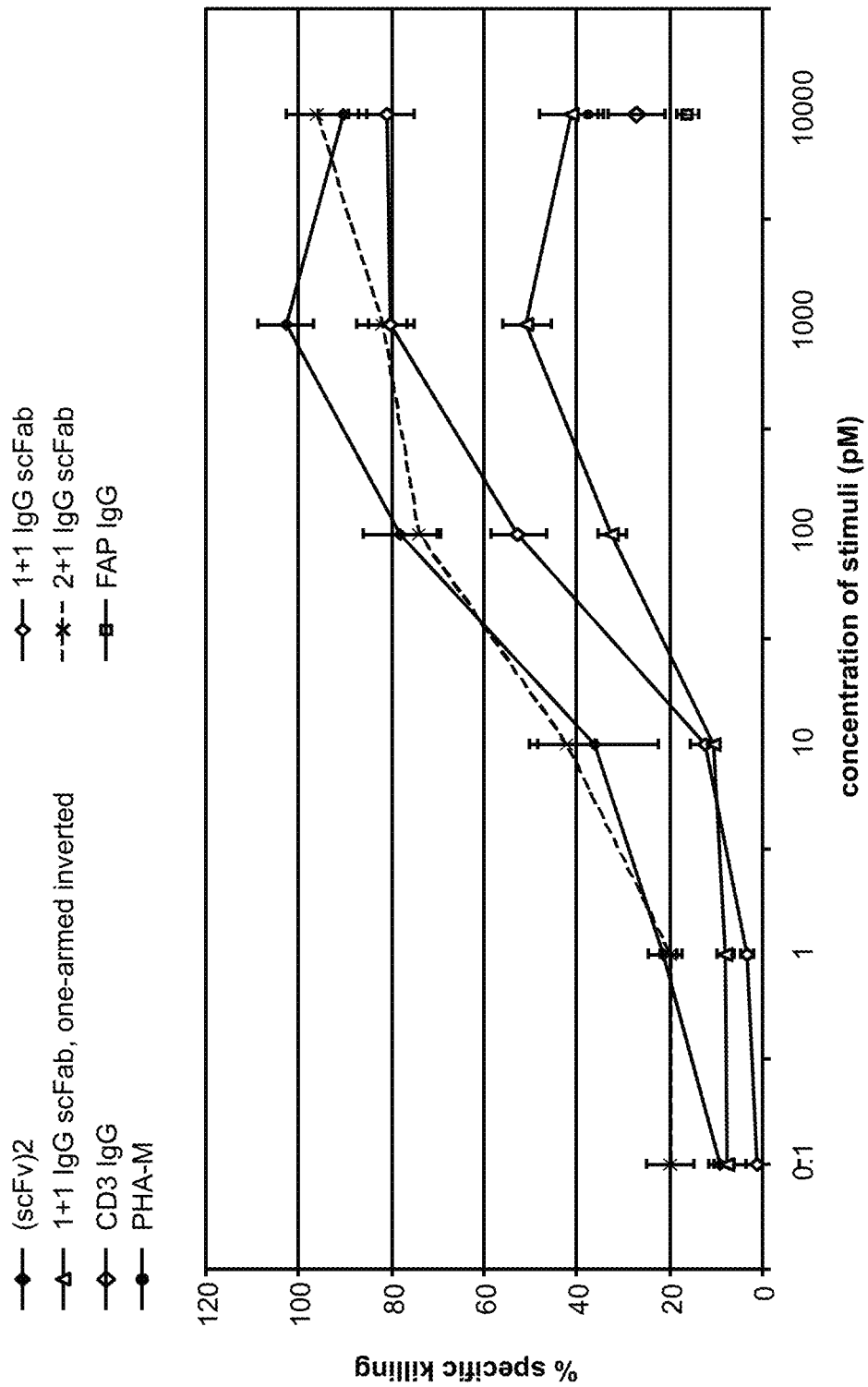
FIG. 42. Killing (as measured by LDH release) of FAP-positive GM05389 fibroblasts upon co-culture with human pan T cells (E:T ratio=5:1), treated with different CD3-FAP bispecific constructs ("1+1 IgG scFab, one armed inverted" (see SEQ ID NOs 11, 51, 55), "1+1 IgG scFab" (see SEQ ID NOs 57, 61, 213), "2+1 IgG scFab" (see SEQ NOs 57, 59, 61) and "(scFv)$_2$") for ~18 hours.

As depicted in FIG. 42, the "2+1 IgG scFab" construct shows comparable cytotoxic activity to the "(scFv)$_2$" molecule in terms of EC50 values. The "1+1 IgG scFab, one-armed inverted" construct is less active than the other constructs tested in this assay.

In another set of experiments, the CD3/MCSP "2+1 IgG Crossfab, linked light chain" (see SEQ ID NOs 3, 5, 29, 179) was compared to the CD3/MCSP "2+1 IgG Crossfab" (see SEQ ID NOs 3, 5, 29, 33). Briefly, target cells (human Colo-38, human MV-3 or WM266-4 melanoma cells) were harvested with Cell Dissociation Buffer on the day of the assay (or with trypsin one day before the assay was started), washed and resuspended in the appropriate cell culture medium (RPMI1640, including 2% FCS and 1% Glutamax). 20,000-30,000 cells per well were plated in a flat-bottom 96-well plate and the respective antibody dilution was added as indicated (triplicates). PBMCs as effector cells were added to obtain a final effector-to-target cell (E:T) ratio of 10:1. All constructs and controls were adjusted to the same molarity, incubation time was 22 h. Detection of LDH release and normalization was done as described above.

Figure 49:
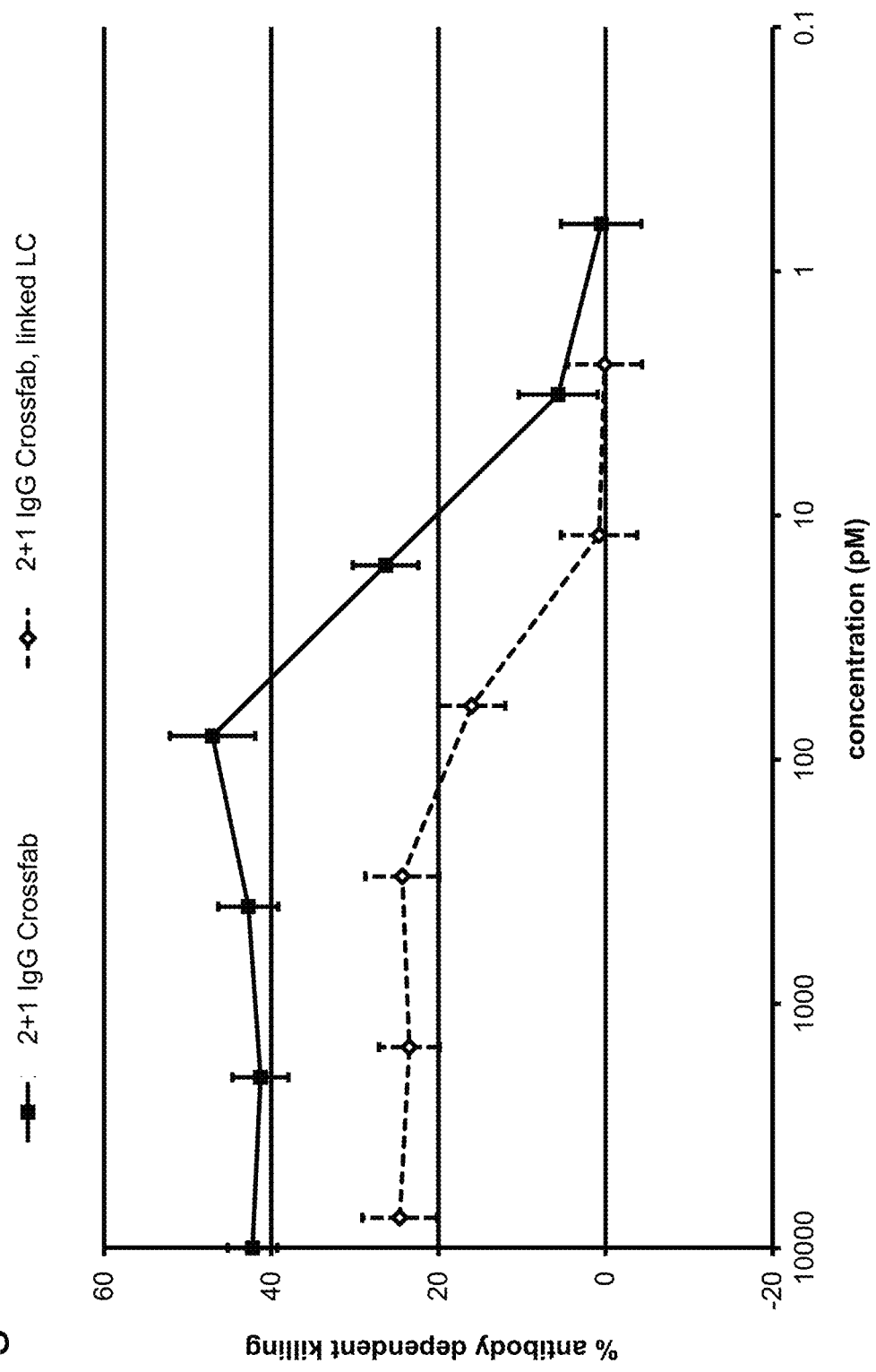
FIG. 49. Killing (as measured by LDH release) of MCSP-positive MV-3 tumor cells upon co-culture by human PBMCs (E:T ratio=10:1), treated with different CD3-MCSP bispecific constructs for 44 hours ("2+1 IgG Crossfab" (see SEQ ID NOs 3, 5, 29, 33) and "2+1 IgG Crossfab, linked LC" (see SEQ ID NOs 3, 5, 29, 179)). Human PBMCs were isolated from fresh blood of healthy volunteers.
Figure 50:
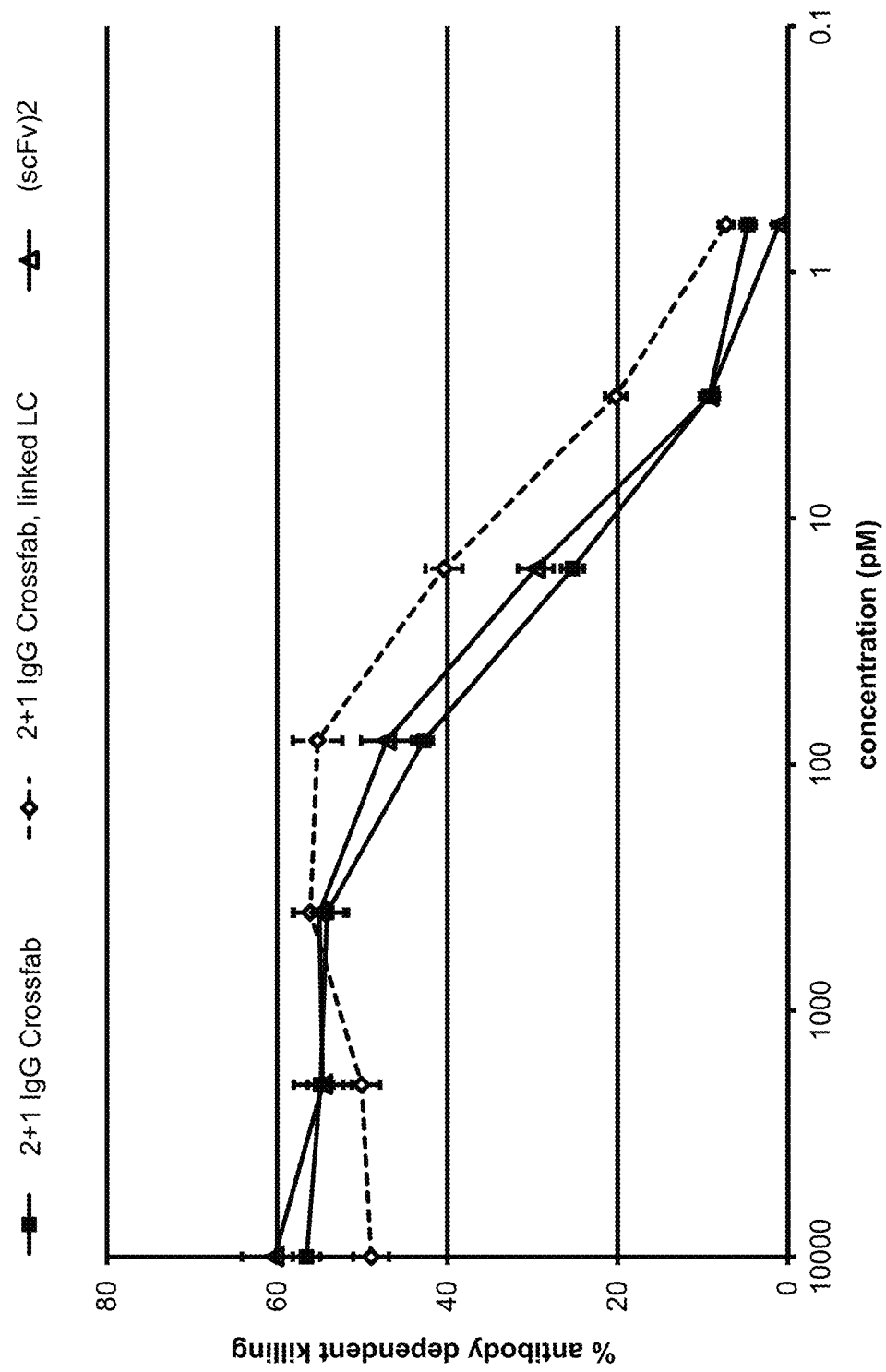
FIG. 50. Killing (as measured by LDH release) of MCSP-positive Colo-38 tumor cells upon co-culture by human PBMCs (E:T ratio=10:1), treated with different CD3-MCSP bispecific constructs for ~22 hours ("2+1 IgG Crossfab" (see SEQ ID NOs 3, 5, 29, 33) and "2+1 IgG Crossfab, linked LC" (see SEQ ID NOs 3, 5, 29, 179)). Human PBMCs were isolated from fresh blood of healthy volunteers.
Figure 51:
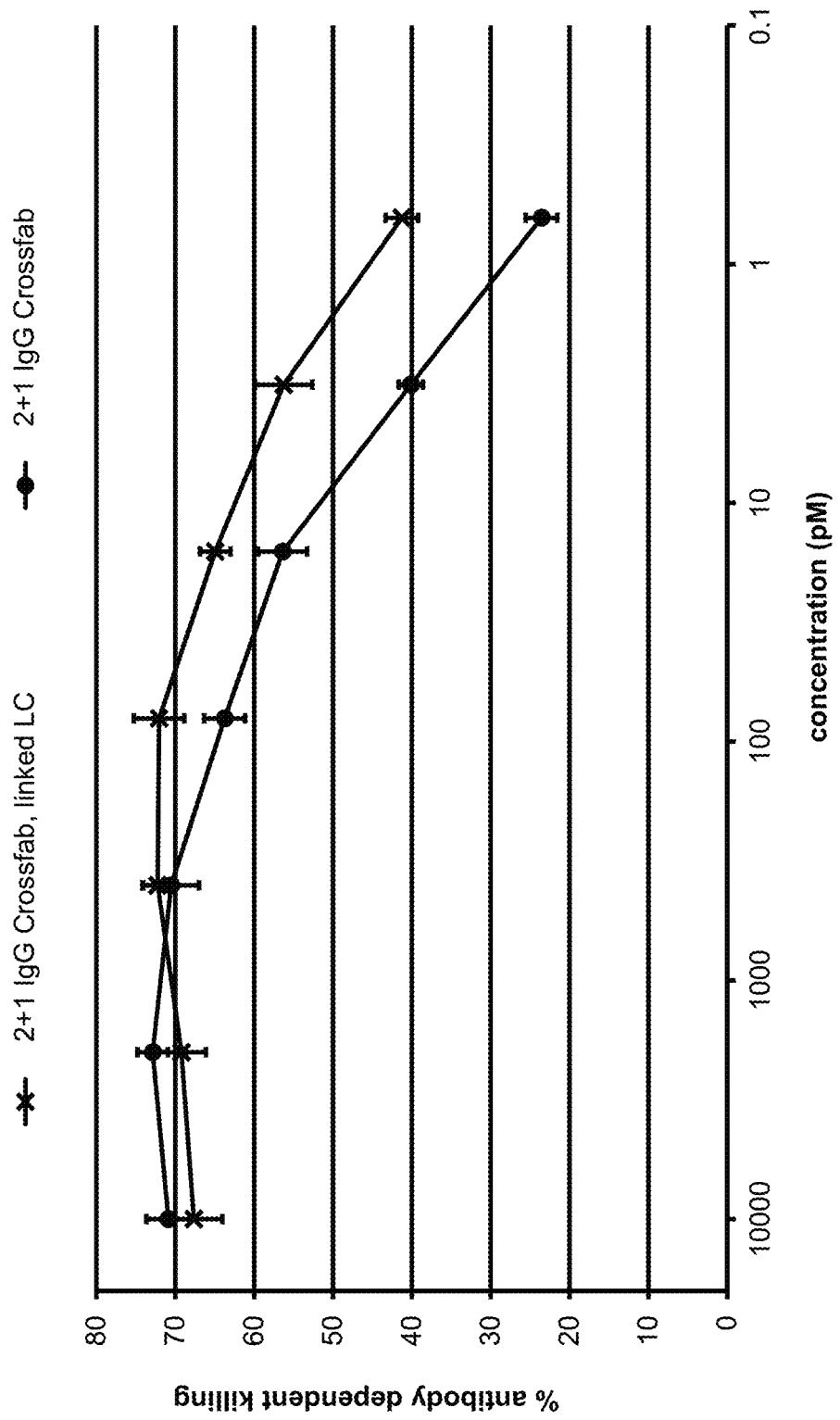
FIG. 51. Killing (as measured by LDH release) of MCSP-positive Colo-38 tumor cells upon co-culture by human PBMCs (E:T ratio=10:1), treated with different CD3-MCSP bispecific constructs for ~22 hours ("2+1 IgG Crossfab" (see SEQ ID NOs 3, 5, 29, 33) and "2+1 IgG Crossfab, linked LC" (see SEQ ID NOs 3, 5, 29, 179)). Human PBMCs were isolated from fresh blood of healthy volunteers.
Figure 52:
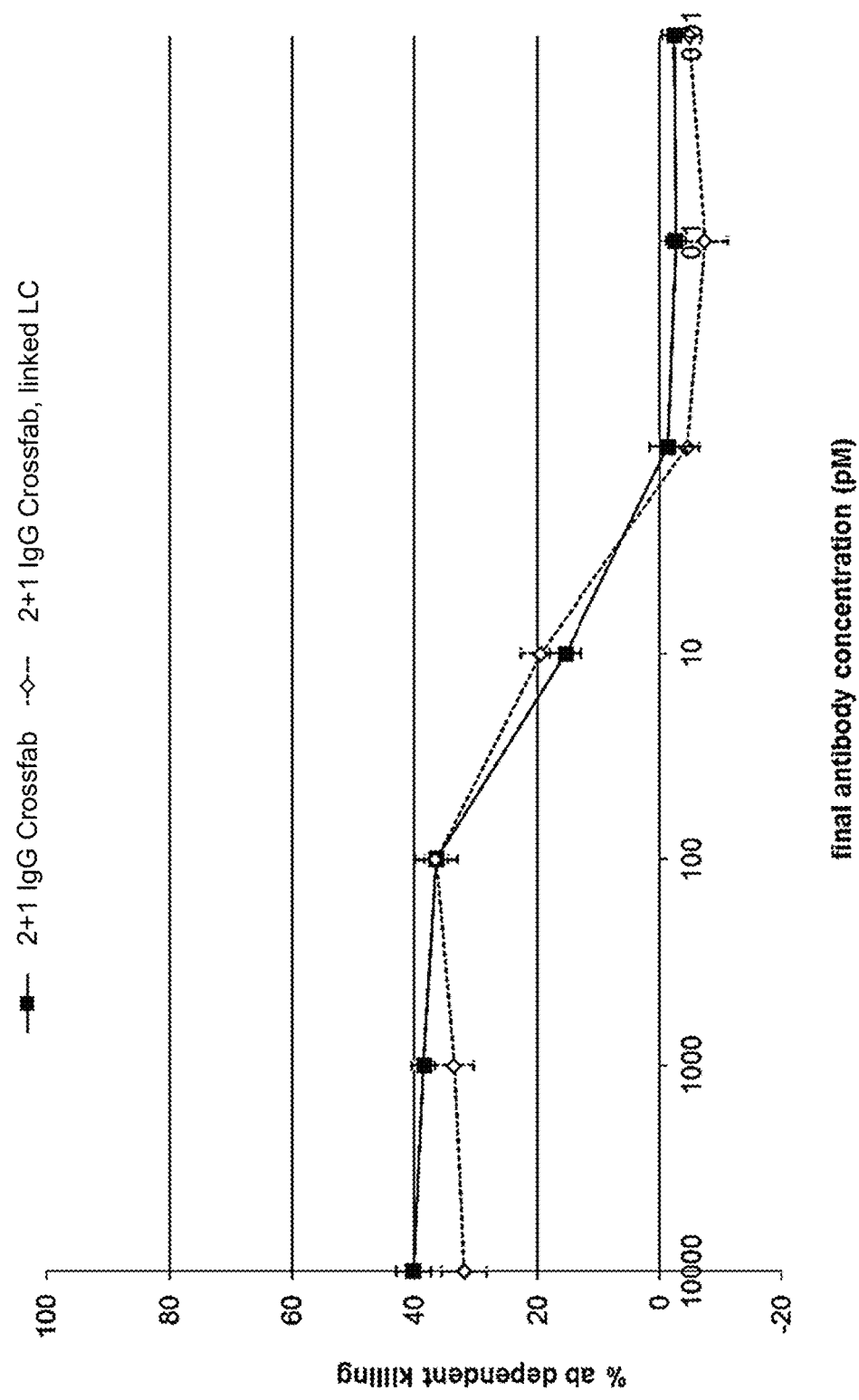
FIG. 52. Killing (as measured by LDH release) of MCSP-positive WM266-4 cells upon co-culture by human PBMCs (E:T ratio=10:1), treated with different CD3-MCSP bispecific constructs for ~22 hours ("2+1 IgG Crossfab" (see SEQ ID NOs 3, 5, 29, 33) and "2+1 IgG Crossfab, linked LC" (see SEQ ID NOs 3, 5, 29, 179)). Human PBMCs were isolated from fresh blood of healthy volunteers.

FIGS. 49 to 52 show the result of four assays performed with MV-3 melanoma cells (FIG. 49), Colo-38 cells (FIGS. 50 and 51) or WM266-4 cells (FIG. 52). As shown in FIG. 49, the construct with the linked light chain was less potent compared to the one without the linked light chain in the assay with MV-3 cells as target cells. As shown in FIGS. 50 and 51, the construct with the linked light chain was more potent compared to the one without the linked light chain in the assays with high MCSP expressing Colo-38 cells as target cells. Finally, as shown in FIG. 52, there was no significant difference between the two constructs when high MCSP-expressing WM266-4 cells were used as target cells.

In another experiment, two CEA-targeting "2+1 IgG Crossfab, inverted" constructs were compared, wherein in the Crossfab fragment either the V regions (VL/VH, see SEQ ID NOs 33, 63, 65, 67) or the C regions (CL/CH1, see SEQ ID NOs 65, 67, 183, 197) were exchanged. The assay was performed as described above, using human PBMCs as effector cells and human CEA-expressing target cells. Target cells (MKN-45 or LS-174T tumor cells) were harvested with trypsin-EDTA (LuBiosciences #25300-096), washed and resuspended in RPMI1640 (Invitrogen #42404042), including 1% Glutamax (LuBiosciences #35050087) and 2% ITS. 30,000 cells per well were plated in a round-bottom 96-well plate and the bispecific constructs were added at the indicated concentrations. All constructs and controls were adjusted to the same molarity. Human PBMC effector cells were added to obtain a final E:T ratio of 10:1, incubation time was 28 h. EC50 values were calculated using the GraphPad Prism 5 software.

Figure 61B:
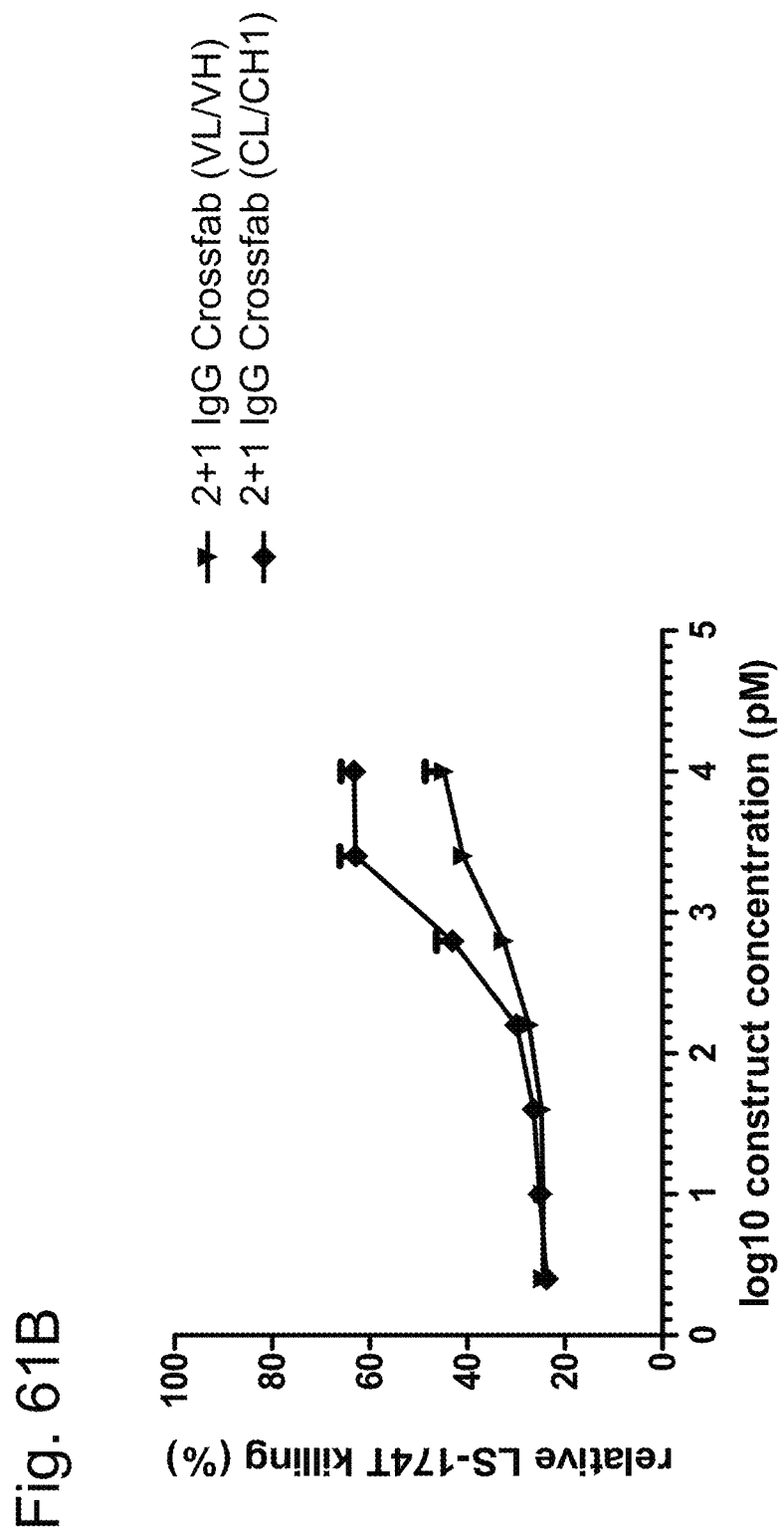

As shown in FIG. 61, the construct with the CL/CH1 exchange shows slightly better activity on both target cell lines than the construct with the VL/VH exchange. Calculated EC50 values were 115 and 243 pM on MKN-45 cells, and 673 and 955 pM on LS-174T cells, for the CL/CH1-exchange construct and the VL/VH-exchange construct, respectively.

Similarly, two MCSP-targeting "2+1 IgG Crossfab" constructs were compared, wherein in the Crossfab fragment either the V regions (VL/VH, see SEQ ID NOs 33, 189, 191, 193) or the C regions (CL/CH1, see SEQ ID NOs 183, 189, 19:3, 195) were exchanged. The assay was performed as described above, using human PBMCs as effector cells and human MCSP-expressing target cells. Target cells (WM266-4) were harvested with Cell Dissociation Buffer (LuBiosciences #13151014), washed and resuspended in RPMI1640 (Invitrogen #42404042), including 1% Glutamax (LuBiosciences #35050087) and 2% FCS. 30,000 cells per well were plated in a round-bottom 96-well plate and the constructs were added at the indicated concentrations. All constructs and controls were adjusted to the same molarity. Human PBMC effector cells were added to obtain a final E:T ratio of 10:1, incubation time was 26 h. EC50 values were calculated using the GraphPad Prism 5 software.

Figure 62:
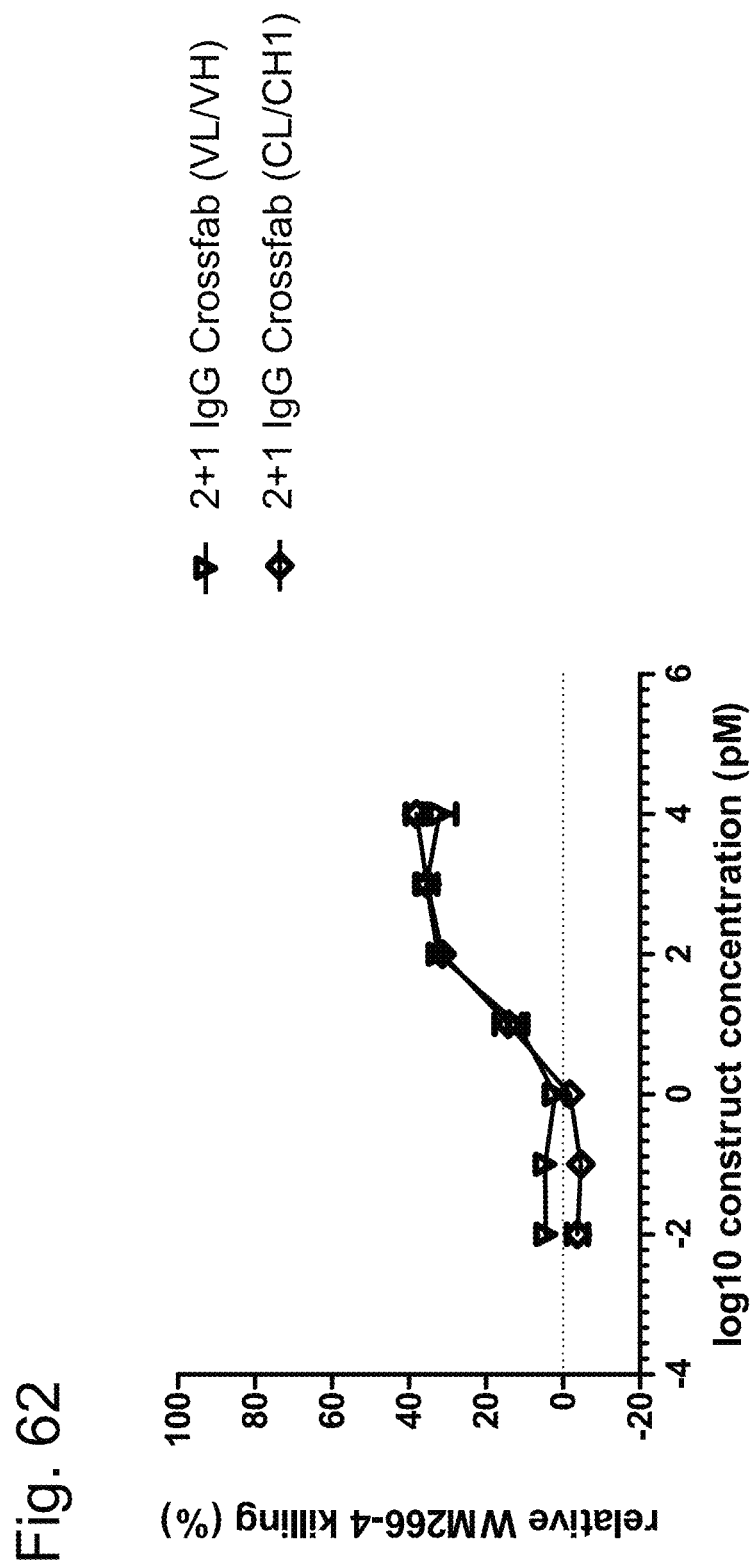
FIG. 62. Killing (as measured by LDH release) of WM266-4 tumor cells upon co-culture with human PBMCs (E:T ratio=10:1) and activation for 26 hours by different concentrations of the "2+1 IgG Crossfab (VL/VH)" (see SEQ ID NOs 33, 189, 191, 193) versus the "2+1 IgG Crossfab (CL/CH1)" (see SEQ ID NOs 183, 189, 193, 195) construct.

As depicted in FIG. 62, the two constructs show comparable activity, the construct with the CL/CH1 exchange having a slightly lower EC50 value (12.9 pM for the CL/CH1-exchange construct, compared to 16.8 pM for the VL/VH-exchange construct).

Figure 63:
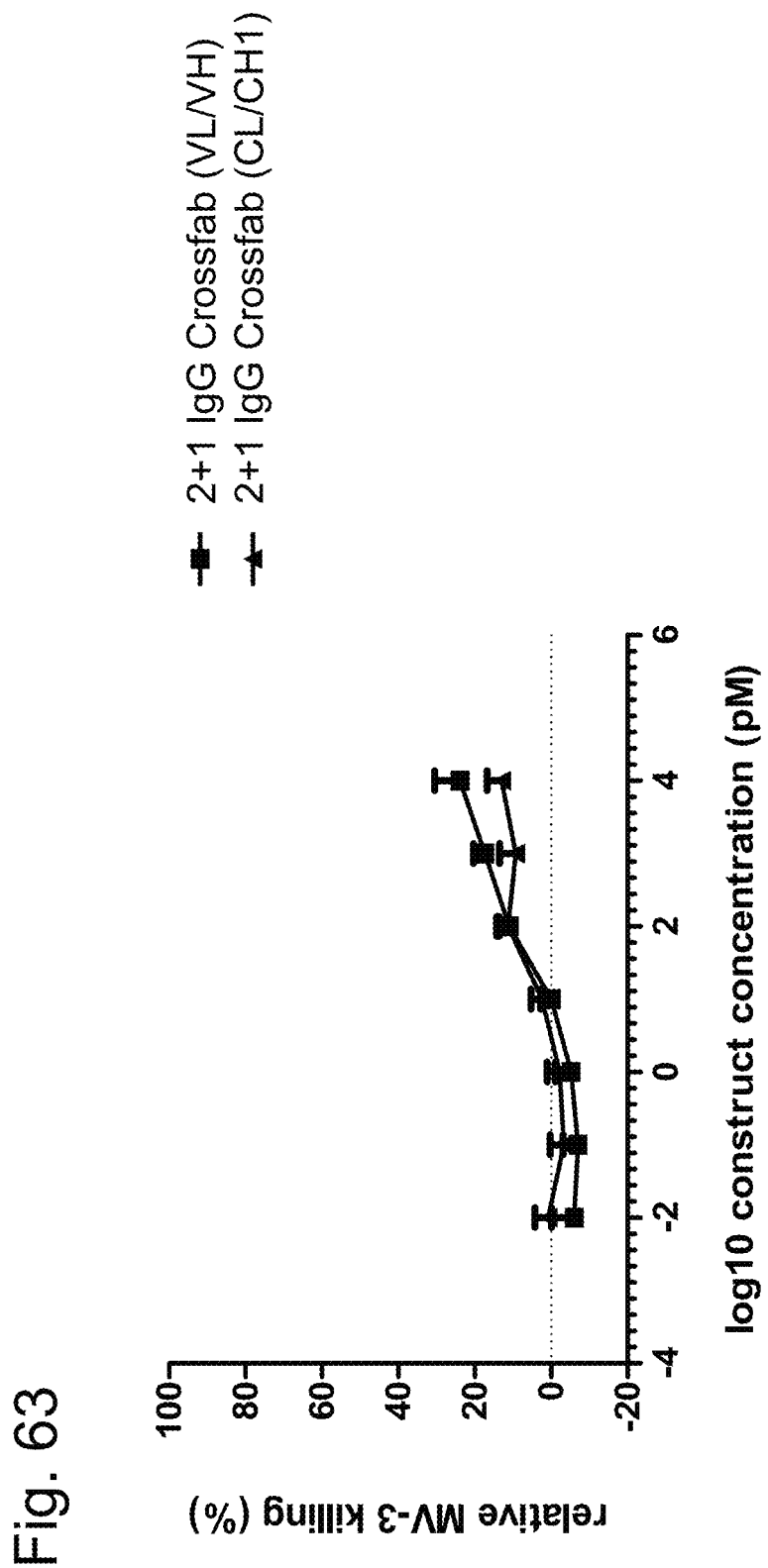
FIG. 63. Killing (as measured by LDH release) of MV-3 tumor cells upon co-culture with human PBMCs (E:T ratio=10:1) and activation for 27 hours by different concentrations of the "2+1 IgG Crossfab (VH/VL)" (see SEQ ID NOs 33, 189, 191, 193) versus the "2+1 IgG Crossfab (CL/CH1)" (see SEQ ID NOs 183, 189, 193, 195) constructs.

FIG. 63 shows the result of a similar assay, performed with human MCSP-expressing MV-3 target cells. Again, both constructs show comparable activity, the construct with the CL/CH1 exchange having a slightly lower EC50 value (approximately 11.7 pM for the CL/CH1-exchange construct, compared to approximately 82.2 pM for the VL/VH-exchange construct). Exact EC50 values could not be calculated, since the killing curves did not reach a plateau at high concentrations of the compounds.

In a further experiment, the CD3/MCSP "2+1 IgG Crossfab" (see SEQ TD NOs 3, 5, 29, 33) and "1+1 IgG Crossfab" (see SEQ ID NOs 5, 29, 33, 181) constructs were compared to the CD3/MCSP "1+1 CrossMab" (see SEQ ID NOs 5, 23, 183, 185). The assay was performed as described above, using human PBMCs as effector cells and WM266-4 or MV-3 target cells (E:T ratio=10:1) and an incubation time of 21 h.

Figure 64A:
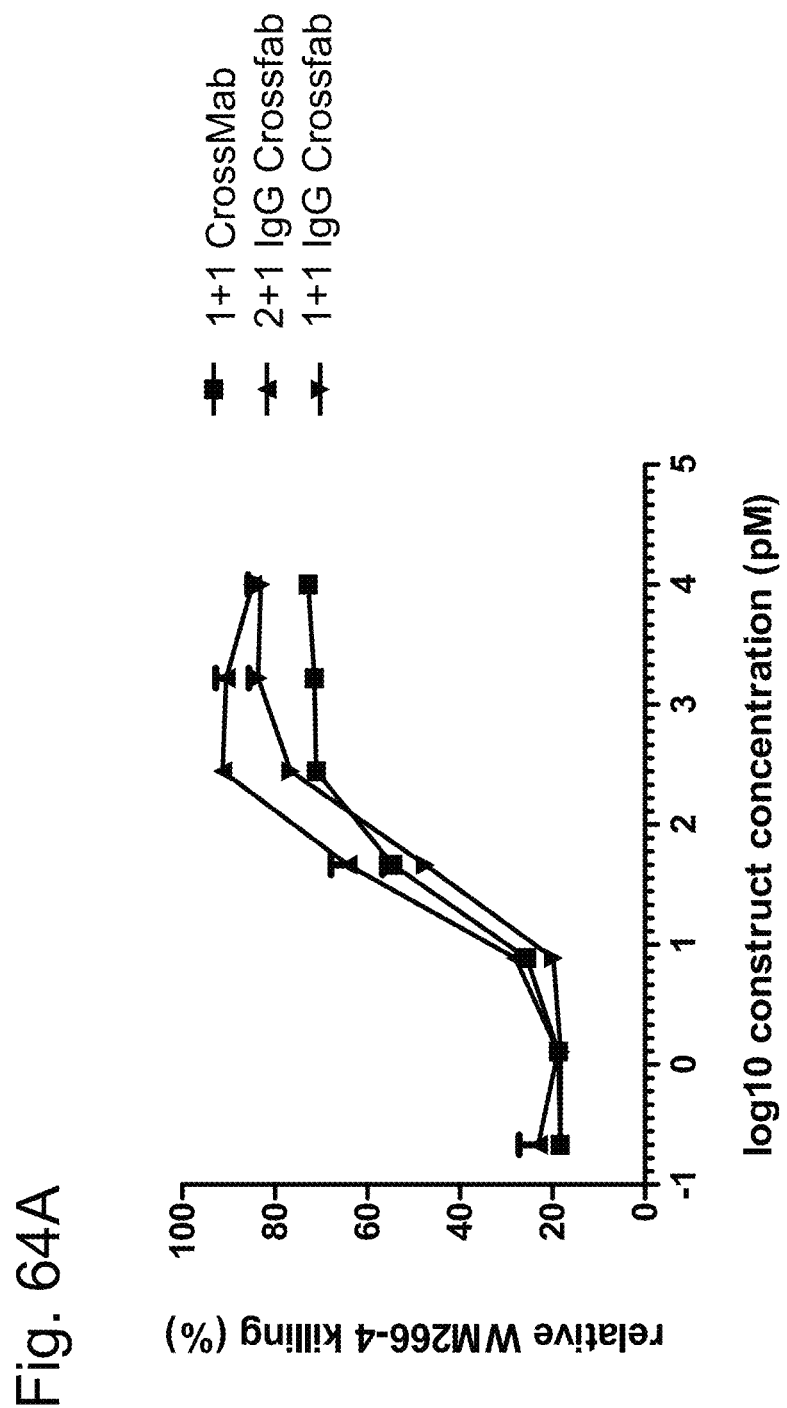
FIGS. 64A and 64B. Killing (as measured by LDH release) of human MCSP-positive WM266-4 (FIG. 64A) or MV-3 (FIG. 64B) tumor cells upon co-culture with human PBMCs (E:T ratio=10:1) and activation for 21 hours by different concentrations of the "2+1 IgG Crossfab" (see SEQ ID NOs 3, 5, 29, 33), the "1+1 CrossMab" (see SEQ ID NOs 5, 23, 183, 185), and the "1+1 IgG Crossfab" (see SEQ ID NOs 5, 29, 33, 181), as indicated.
Figure 64B:
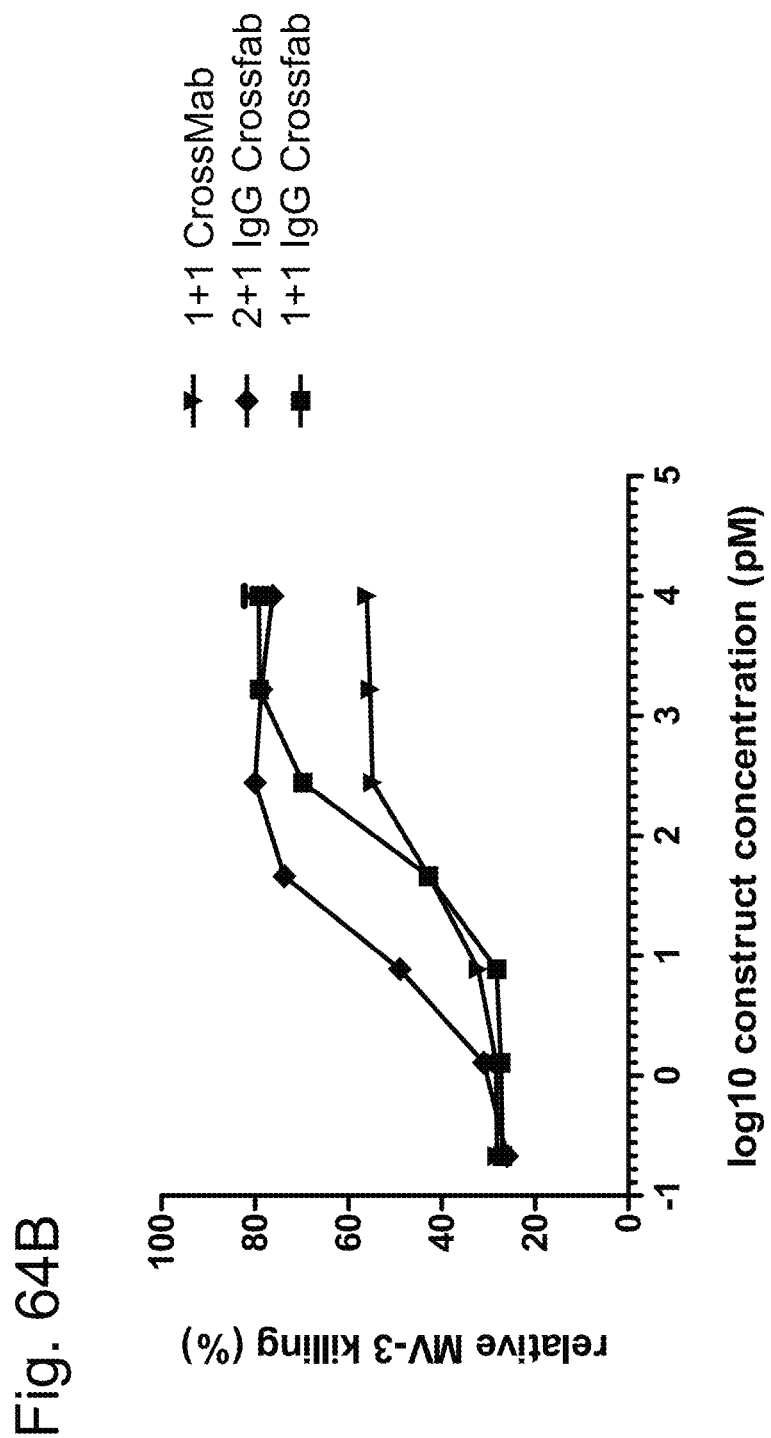

As shown in FIG. 64, the "2+1 IgG Crossfab" construct is the most potent molecule in this assay, followed by the "1+1 IgG Crossfab" and the "1+1 CrossMab". This ranking is even more pronounced with MV-3 cells, expressing medium levels of MCSP, compared to high MCSP expressing WM266-4 cells. The calculated EC50 values on MV-3 cells were 9.2, 40.9 and 88.4 pM, on WM266-4 cells 33.1, 28.4 and 53.9 pM, for the "2+1 IgG Crossfab", the "1+1 IgG Crossfab" and the "1+1 CrossMab", respectively.

Figure 65B:
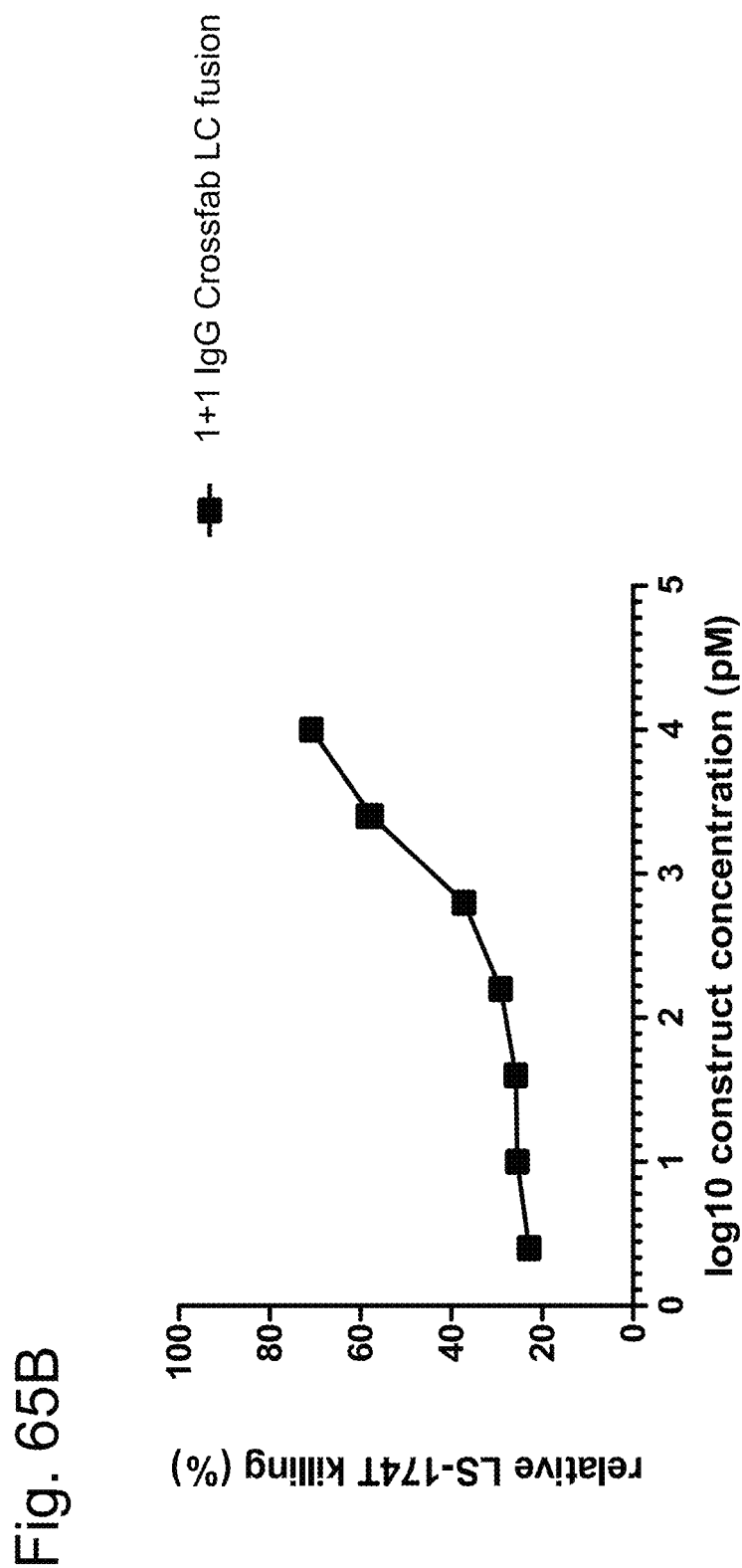

In a further experiment, different concentrations of the "1+1 IgG Crossfab LC fusion" construct (SEQ ID NOs 183, 209, 211, 213) were tested, using MKN-45 or LS-174T tumor target cells and human PBMC effector cells at an E:T ratio of 10:1 and an incubation time of 28 hours. As shown in FIG. 65, the "1+1 IgG Crossfab LC fusion" construct induced apoptosis in MKN-45 target cells with a calculated EC50 of 213 pM, whereas the calculated EC50 is 1.56 nM with LS-174T cells, showing the influence of the different tumor antigen expression levels on the potency of the bispecific constructs within a certain period of time.

Figure 66:
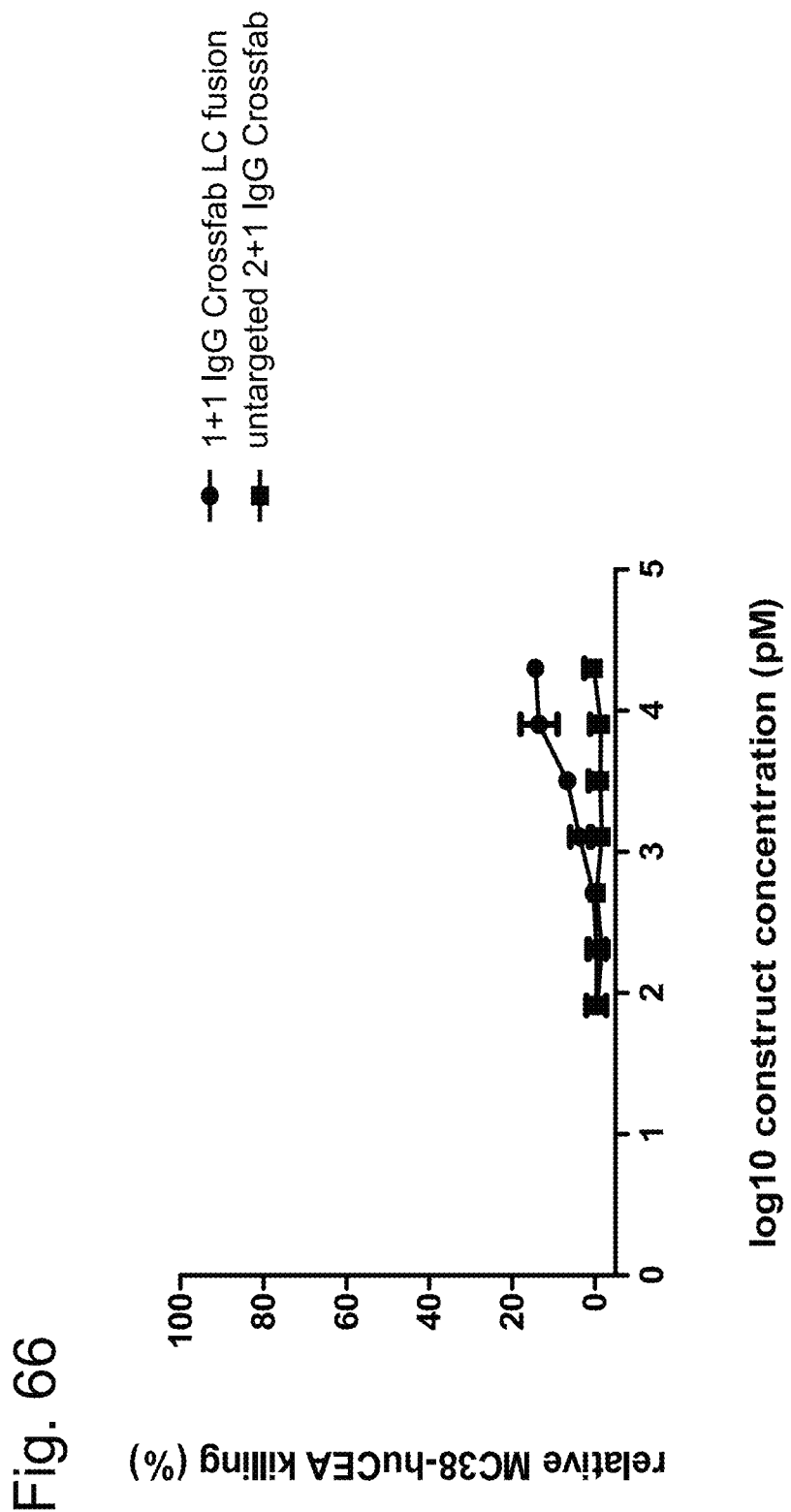
FIG. 66. Killing (as measured by LDH release) of MC38-huCEA tumor cells upon co-culture with human PBMCs (E:T ratio=10:1) and activation for 24 hours by different concentrations of the "1+1 IgG Crossfab LC fusion" (see SEQ ID NOs 183, 209, 211, 213) versus an untargeted "2+1 IgG Crossfab" reference.

In yet another experiment, the "1+1 IgG Crossfab LC; fusion" construct (SEQ ID NOs 183, 209, 211, 213) was compared to a untargeted "2+1 IgG Crossfab" molecule. MC38-huCEA tumor cells and human PBMCs (E:T ratio=10:1) and an incubation time of 24 hours were used. As shown in FIG. 66, the "1+1 IgG Crossfab LC fusion" construct induced apoptosis of target cells in a concentration-dependent manner, with a calculated EC50 value of approximately 3.2 nM. In contrast, the untargeted "2+1 IgG Crossfab" showed antigen-independent T cell-mediated killing of target cells only at the highest concentration.

Figure 67A:
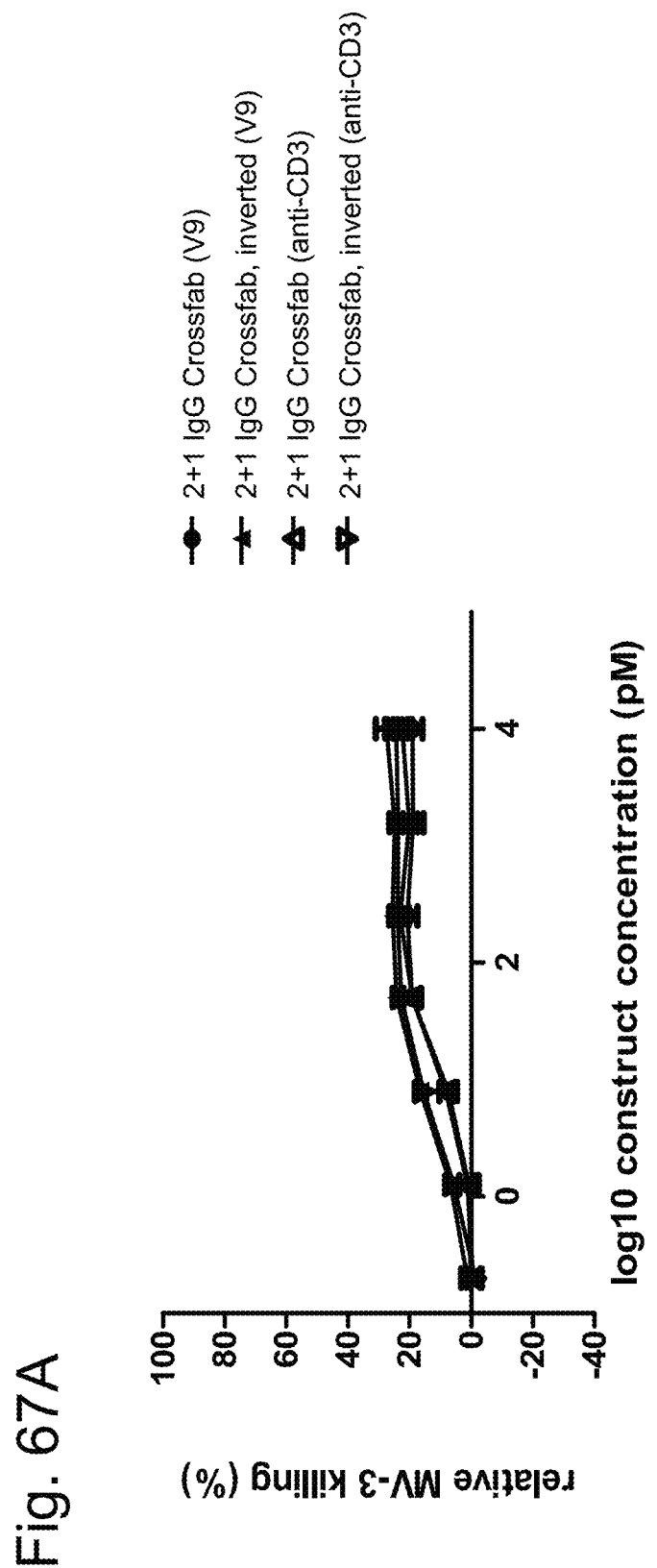
FIGS. 67A and 67B. Killing (as measured by LDH release) of human MCSP-positive MV-3 (FIG. 67A) or WM266-4 (FIG. 67B) tumor cells upon co-culture with human PBMCs (E:T ratio=10:1), treated with the "2+1 IgG Crossfab (V9)" (see SEQ ID NOs 3, 5, 29, 33) and the "2+1 IgG Crossfab, inverted (V9)" (see SEQ ID NOs 5, 23, 183, 187), the "2±1 IgG Crossfab (anti-CD3)" (see SEQ ID NOs 5, 23, 215, 217) and the "2+1 IgG Crossfab, inverted (anti-CD3)" (see SEQ ID NOs 5, 23, 215, 219) constructs.
Figure 67B:
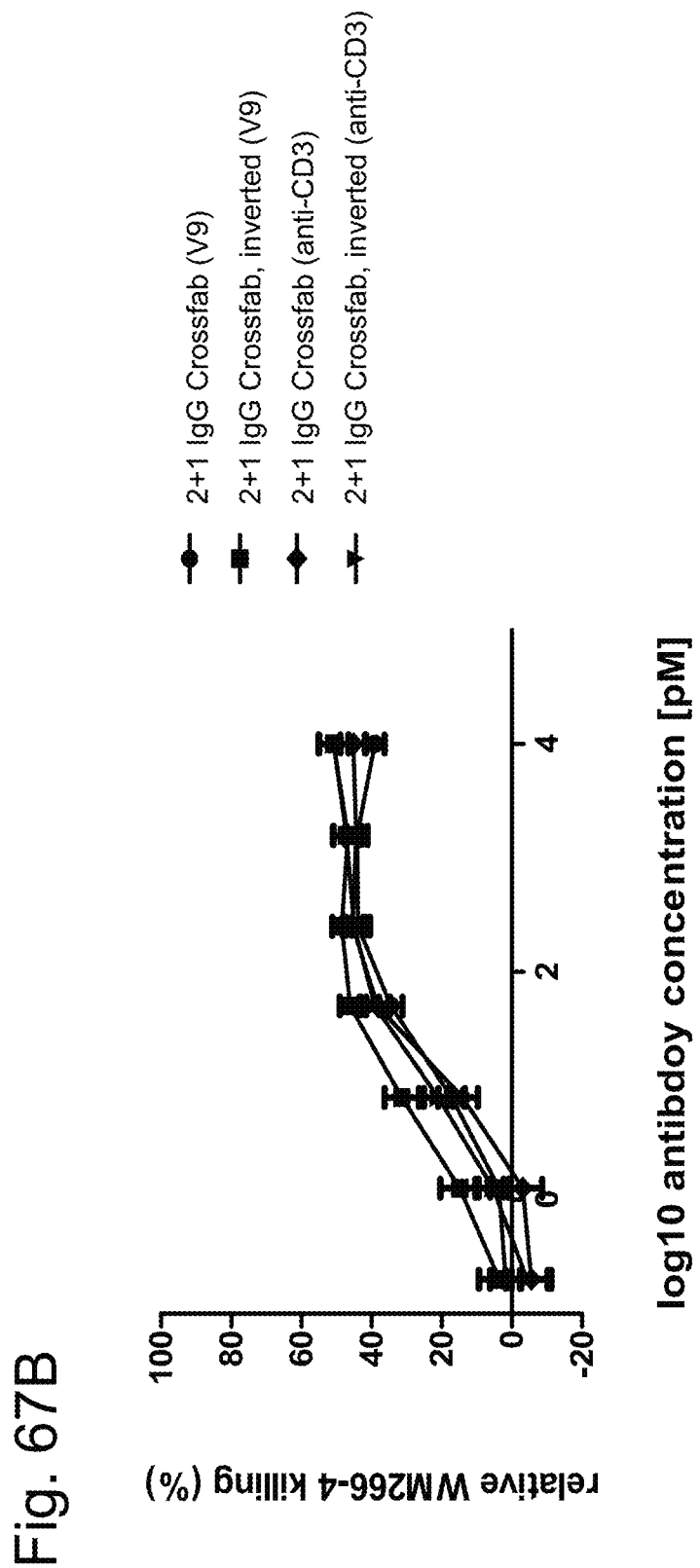

In a final experiment, the "2+1 IgG Crossfab (V9)" (SEQ ID NOs 3, 5, 29, 33), the "2+1 IgG Crossfab, inverted (V9)" (SEQ ID NOs 5, 23, 183, 187), the "2+1 IgG Crossfab (anti-CD3)" (SEQ ID NOs 5, 23, 215, 217), the "2+1 IgG Crossfab, inverted (anti-CD3)" (SEQ ID NOs 5, 23, 215, 219) were compared, using human MCSP-positive MV-3 or WM266-4 tumor cells and human PBMCs (E:T ratio=10:1), and an incubation time of about 24 hours. As depicted in FIG. 67, the T cell-mediated killing of the "2+1 IgG Crossfab, inverted" constructs seems to be slightly stronger or at least equal to the one induced by the "2+1 IgG Crossfab" constructs for both CD3 binders. The calculated EC50 values were as follows:

| EC50 [pM] | 2 + 1 IgG Crossfab (V9) | 2 + 1 IgG Crossfab inverted (V9) | 2 + 1 IgG Crossfab (anti-CD3) | 2 + 1 IgG Crossfab, inverted (anti-CD3) |
|---|---|---|---|---|
| MV-3 | 10.0 | 4.1 | 11.0 | 3.0 |
| WM266-4 | 12.4 | 3.7 | 11.3 | 7.1 |

Example 7

CD107a/b Assay

Purified "2+1 IgG scFab" construct (SEQ ID NOs 5, 17, 19) and the "(scFv)$_2$" molecule, both targeting human MCSP and human CD3, were tested by flow cytometry for their potential to up-regulate CD107a and intracellular perforin levels in the presence or absence of human MCSP-expressing tumor cells.

Briefly, on day one, 30,000 Colo-38 tumor target cells per well were plated in a round-bottom 96-well plate and incubated overnight at 37° C., 5% CO$_2$ to let them adhere. Primary human pan T cells were isolated on day 1 or day 2 from Buffy Coat, as described.

On day two, 0.15 million effector cells per well were added to obtain a final E:T ratio of 5:1. FITC-conjugated CD107a/b antibodies, as well as the different bispecific constructs and controls are added. The different bispecific molecules and antibodies were adjusted to same molarities to obtain a final concentration of 9.43 nM. Following a 1 h incubation step at 37° C., 5% CO$_2$, monensin was added to inhibit secretion, but also to neutralize the pH within endosomes and lysosomes. After an additional incubation time of 5 h, cells were stained at 4° C. for 30 min for surface CD8 expression. Cells were washed with staining buffer (PBS/0.1% BSA), fixed and permeabilized for 20 min using the BD Cytofix/Cytoperm Plus Kit with BD Golgi Stop (BD Biosciences #554715). Cells were washed twice using 1×BD Perm/Wash buffer, and intracellular staining for perforin was performed at 4° C. for 30 min. After a final washing step with 1×BD Perm/Wash buffer, cells were resuspended in PBS/0.1% BSA and analyzed on FACS CantoII (all antibodies were purchased from BD Biosciences or BioLegend).

Gates were set either on all CD107a/b positive, perforin-positive or double-positive cells, as indicated (FIG. 43). The "2+1 IgG scFab" construct was able to activate T cells and up-regulate CD107a/b and intracellular perforin levels only in the presence of target cells (FIG. 43 panel A), whereas the "(scFv)$_2$" molecule shows (weak) induction of activation of T cells also in the absence of target cells (FIG. 43 panel B). The bivalent reference anti-CD3 IgG results in a lower level of activation compared to the "(scFv)$_2$" molecule or the other bispecific construct.

Example 8

Proliferation Assay

The purified "2+1 IgG scFab" (SEQ ID NOs 5, 17, 19) and "(scFv)$_2$" molecules, both targeting human CD3 and human MCSP, were tested by flow cytometry for their potential to induce proliferation of CD8$^+$ or CD4$^+$ T cells in the presence and absence of human MCSP-expressing tumor cells.

Briefly, freshly isolated human pan cells were adjusted to 1 million cells per ml in warm PBS and stained with 1 µM CFSE at room temperature for 10 minutes. The staining volume was doubled by addition of RPMI1640 medium, containing 10% ITS and 1% GlutaMax. After incubation at room temperature for further 20 min, the cells were washed three times with pre-warmed medium to remove remaining CFSE. MCSP-positive Colo-38 cells were harvested with Cell Dissociation buffer, counted and checked for viability. Cells were adjusted to 0.2×10$^6$ (viable) cells per ml in AIM-V medium, 100 µl of this cell suspension were pipetted per well into a round-bottom 96-well plate (as indicated). 50 µl of the (diluted) bispecific constructs were added to the cell-containing wells to obtain a final concentration of 1 nM. CFSE-stained human pan T effector cells were adjusted to 2×10$^6$ (viable) cells per ml in AIM-V medium. 50 µl of this cell suspension was added per well of the assay plate (see above) to obtain a final E:T ratio of 5:1. To analyze whether the bispecific constructs are able to activate T cells only in the presence of target cells, expressing the tumor antigen huMCSP, wells were included that contained 1 nM of the respective bispecific molecules as well as PBMCs, but no target cells. After incubation for five days at 37° C., 5% CO$_2$, cells were centrifuged (5 min, 350×g) and washed twice with 150 µl/well PBS, including 0.1% BSA. Surface staining for CD8 (mouse IgG1, κ; clone HIT8a; BD #555635), CD4 (mouse IgG1, κ; clone RPA-T4; BD #560649), or CD25 (mouse IgG1, κ; clone M-A251; BD #555434) was performed at 4° C. for 30 min, according to the supplier's suggestions. Cells were washed twice with 150 µl/well PBS containing 0.1% BSA, resuspended in 200 µl/well PBS with 0.1% BSA, and analyzed using a FACS Canton machine (Software FACS Diva). The relative proliferation level was determined by setting a gate around the non-proliferating cells and using the cell number of this gate relative to the overall measured cell number as the reference.

Figure 44B:
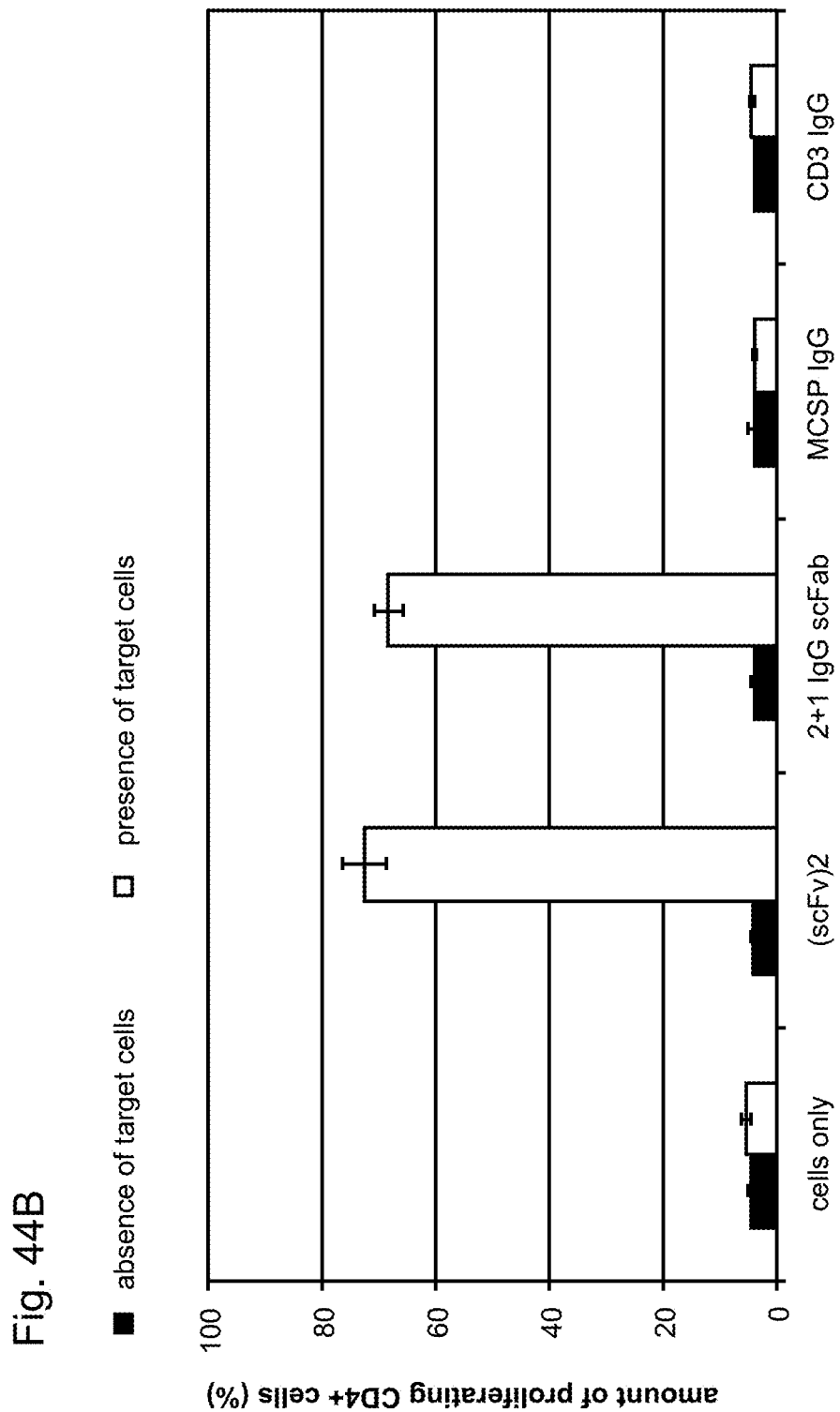

FIG. 44 shows that all constructs induce proliferation of CD8$^+$ T cells (A) or CD4$^+$ T cells (B) only in the presence of target cells, comparably to the "(scFv)$_2$" molecule. In general, activated CD8+ T cells proliferate more than activated CD4+ T cells in this assay.

Example 9

Cytokine Release Assay

The purified "2+1 IgG scFab" construct (SEQ ID NOs 5, 17, 19) and the "(scFv)$_2$" molecule, both targeting human MCSP and human CD3, were analyzed for their ability to induce T cell-mediated de novo secretion of cytokines in the presence or absence of tumor target cells.

Briefly, human PBMCs were isolated from Buffy Coats and 0.3 million cells were plated per well into a round-bottom 96-well plate. Colo-38 tumor target cells, expressing human MCSP, were added to obtain a final E:T-ratio of 10:1. Bispecific constructs and IgG controls were added at 1 nM final concentration and the cells were incubated for 24 h at 37° C., 5% $CO_2$. The next day, the cells were centrifuged for 5 min at 350×g and the supernatant was transferred into a new deep-well 96-well-plate for the subsequent analysis. The CBA analysis was performed according to manufacturer's instructions for FACS CantoII, using the Human Th1/Th2 Cytokine Kit II (BD #551809).

Figure 45A:
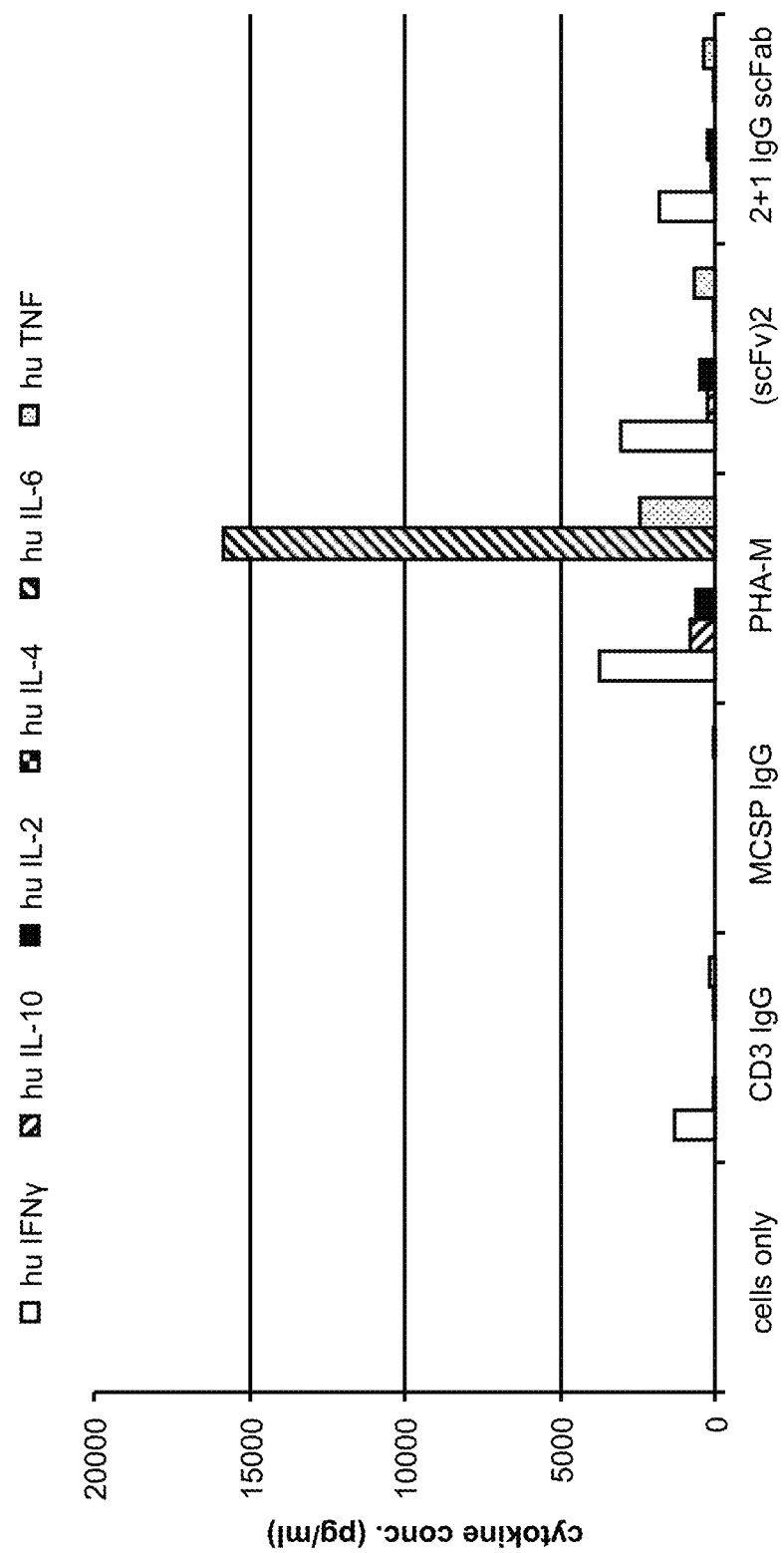
FIGS. 45A and 45B. Levels of different cytokines measured in the supernatant of human PBMCs after treatment with 1 nM of different CD3-MCSP bispecific constructs ("2+1 IgG scFab, LALA" (see SEQ ID NOs 5, 17, 19) or "(scFv)$_2$") or corresponding control IgGs in the presence (FIG. 45A) or absence (FIG. 45B) of Colo-38 tumor cells for 24 hours. The effector to target cell ratio was 10:1.
Figure 45B:
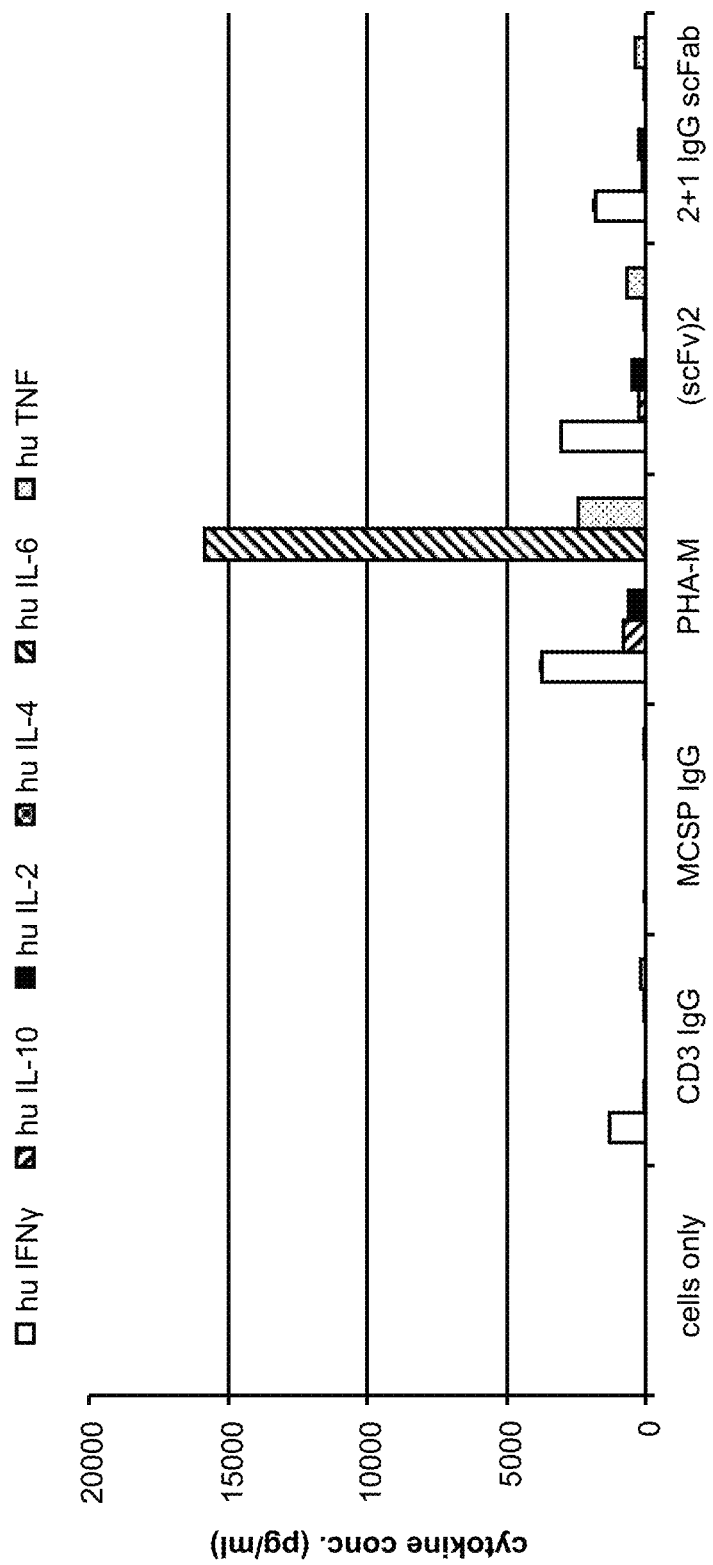

FIG. 45 shows levels of the different cytokine measured in the supernatant. In the presence of target cells the main cytokine secreted upon T cell activation is IFN-γ. The "(scFv)$_2$" molecule induces a slightly higher level of IFN-γ than the "2+1 IgG scFab" construct. The same tendency might be found for human TNF, but the overall levels of this cytokine were much lower compared to IFN-γ. There was no significant secretion of Th2 cytokines (IL-10 and IL-4) upon activation of T cells in the presence (or absence) of target cells. In the absence of Colo-38 target cells, only very weak induction of TNF secretion was observed, which was highest in samples treated with the "(scFv)$_2$" molecule.

In a second experiment, the following purified bispecific constructs targeting human MCSP and human CD3 were analyzed: the "2+1 IgG Crossfab" construct (SEQ ID NOs 3, 5, 29, 33), the "(scFv7)$_2$" molecule, as well as different "2+1 IgG scFab" molecules comprising either a wild-type or a mutated (LALA, P329G and/or N297D, as indicated) Fc domain. Briefly, 280 µl whole blood from a healthy donor were plated per well of a deep-well 96-well plate. 30,000 Colo-38 tumor target cells, expressing human MCSP, as well as the different bispecific constructs and IgG controls were added at 1 nM final concentration. The cells were incubated for 24 h at 37° C., 5% $CO_2$ and then centrifuged for 5 min at 350×g. The supernatant was transferred into a new deep-well 96-well-plate for the subsequent analysis. The CBA analysis was performed according to manufacturer's instructions for FACS CantoII, using the combination of the following CBA Flex Sets: human granzyme B (BD #560304), human IFN-γ Flex Set (BD #558269), human TNF Flex Set (BD #558273), human IL-10 Flex Set (BD #558274), human IL-6 Flex Set (BD #558276), human IL-4 Flex Set (BD #4558272), human IL-2 Flex Set (BD #4558270).

FIG. 46 shows the levels of the different cytokine measured in the supernatant. The main cytokine secreted in the presence of Colo-38 tumor cells was IL-6, followed by IFN-γ. In addition, also the levels of granzyme B strongly increased upon activation of T cells in the presence of target cells. In general, the "(scFv)$_2$" molecule induced higher levels of cytokine secretion in the presence of target cells (FIG. 46, panels A and B). There was no significant secretion of Th2 cytokines (IL-10 and IL-4) upon activation of T cells in the presence (or absence) of target cells.

In this assay, there was a weak secretion of IFN-γ, induced by different "2+1 IgG scFab" constructs, even in the absence of target cells (FIG. 46, panels C and D). Under these conditions, no significant differences could be observed between "2+1 IgG scFab" constructs with a wild-type or a mutated Fc domain.

Example 10

Affinity Maturation of Anti-MCSP Antibody M4-3/ML2

Affinity maturation was performed via the oligonucleotide-directed mutagenesis procedure. For this procedure the heavy chain variant M4-3, and the light chain variant ML2 were cloned into a phagemid vector, similar to those described by Hoogenboom, (Hoogenboom et al., Nucleic Acids Res. 1991, 19, 4133-4137). Residues to be randomized were identified by first generating a 3D model of that antibody via classical homology modeling and then identifying the solvent accessible residues of the complementary determining regions (CDRs) of heavy and light chain. Oligonucleotides with randomization based on trinucleotide synthesis as shown in table 4 were purchased from Ellabiotech (Munich, Germany). Three independent sublibraries were generated via classical PCR, and comprised randomization in CDR-H1 together with CDR-H2, or CDR-L1 together with CDR-L2, CDR-L3 was randomized in a separate approach. The DNA fragments of those libraries were cloned into the phagemid via restriction digest and ligation, and subsequently electroporated into TG1 bacteria.

Library Selection

The antibody variants thus generated were displayed in a monovalent fashion from filamentous phage particles as fusions to the gene III product of M13 packaged within each particle. The phage-displayed variants were then screened for their biological activities (here: binding affinity) and candidates that have one or more improved activities were used for further development. Methods for making phage display libraries can be found in Lee et al., J. Mol. Biol. (2004) 340, 1073-1093), Selections with all affinity maturation libraries were carried out in solution according to the following procedure: 1. binding of ~1012 phagemid particles of each affinity maturation libraries to 100 nM biotinylated hu-MCSP(D3 domain)-avi-his (SEQ ID NO. 390) for 0.5 h in a total volume of 1 ml, 2. capture of biotinylated hu-MCSP(D3 domain)-avi-his and specifically bound phage particles by addition of 5.4×107 streptavidin-coated magnetic beads for 10 min, 3. washing of beads using 5-10× 1 ml PBS/Tween20 and 5-10× 1 ml PBS, 4. elution of phage particles by addition of 1 ml 100 mM TEA (triethylamine) for 10 min and neutralization by adding 500 ul 1 M Tris/HCl pH 7.4 and 5. re-infection of exponentially growing E. coli TG1 bacteria, infection with helper phage VCSM13 and subsequent PEG/NaCl precipitation of phagemid particles to be used in subsequent selection rounds. Selections were carried out over 3-5 rounds using either constant or decreasing (from 10-7 M to 2×10-9 M) antigen concentrations. In round 2, capture of antigen: phage complexes was performed using neutravidin plates instead of streptavidin beads. Specific binders were identified by ELISA as follows: 100 ul of 10 nM biotinylated hu-MCSP(D3 domain)-avi-his per well were coated on neutravidin plates. Fab-containing bacterial supernatants were added and binding Fabs were detected via their Flag-tags by using an anti-Flag/HRP secondary antibody. ELISA-positive clones were bacterially expressed as soluble Fab fragments in 96-well format and supernatants were subjected to a kinetic screening experiment by SPR-analysis using ProteOn XPR36 (BioRad). Clones expressing Fabs with the highest affinity constants were identified and the corresponding phagemids were sequenced.

TABLE 4

(excluded were always Cys, and Met. Lys was excluded on top in those cases where the oligonucleotide was a reverse primer)

| Position | Randomization |
|---|---|
| Heavy chain CDR1 | |
| Ser31 | S (40%), rest (60%, 4% each) |
| Gly32 | G (40%), rest (60%, 4% each). |
| Tyr33 | Y (40%), rest (60%, 4% each) |
| Tyr34 | Y (40%), rest (60%, 4% each) |
| CDR2 | |
| Tyr50 | Y 40%, (F, W, L, A, I, 30%, 6% each), rest (30%, 2.5% each) |
| Thr52 | T (60%), rest (40%, 2.5% each) |
| Tyr53 | Y (40%), rest (60%, 3.8% each) |
| Asp54 | D (40%), rest (60%, 3.8% each) |
| Ser56 | S (40%), rest (60%, 3.8% each) |
| Light chain CDR1 | |
| Gln27 | Q (40%), (E, D, N, S, T, R, 40%, 6.7% each), rest (total 20%, 2.2% each) |
| Gly28 | G (40%), (N, T, S, Q, Y, D, E, 40%, 5.7% each), rest (20%, 2.5% each) |
| Asn31 | N (40%), (S, T, G, Q, Y, D, E, R, 50%, 6.3% each), rest (10%, 1.4% each) |
| Tyr32 | Y (40%), (W, S, R, 30%, 10% each), rest (30%, 2.3% each) |
| CDR2 | |
| Tyr50 | Y (70%), (E, R, K, A, Q, T, S, D, G, W, F, 30%, 2.7% each) |
| Thr51 | T (50%), (S, A, G, N, Q, V, 30%, 5% each), rest (20%, 2% each) |
| Ser52 | S (50%), rest (50%, 3.1% each) |
| Ser53 | S (40%), (N, T, Q, Y, D, E, I, 40%, 5.7% each), rest (20%, 2.2% each) |
| CDR3 | |
| Tyr91 | Y (50%), rest (50%, 3.1% each) |
| Ser92 | S (50%), (N, Q, T, A, G 25%, 5% each), rest (25%, 2.3% each) |
| Lys93 | K (50%), S (5%), T (5%), N (5%), rest (35%, 2.7% each) |
| Leu94 | L (50%), (Y, F, S, I, A, V, 30%, 5% each), rest (20%, 2% each) |
| Pro95 | P (50%), (S, A, 20%, 10% each), rest (30%, 2.1% each) |
| Trp96 | W 50%, (Y, R, L, 15%, 5% each), rest (35%, 2.5% each) |

FIG. 84 shows an alignment of affinity matured anti-MCSP clones compared to the non-matured parental clone (M4-3 ML2). Heavy chain randomization was performed only in the CDR1 and 2. Light chain randomization was performed in CDR1 and 2, and independently in CDR3.

During selection, a few mutations in the frameworks occurred like F71Y in clone G3 or Y87H in clone E10

Production and Purification of Human IgG1

The variable region of heavy and light chain DNA sequences of the affinity matured variants were subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contained an EBV OriP sequence.

The molecule was produced by co-transfecting HEK293-EBNA cells with the mammalian expression vectors using polyethylenimine. The cells were transfected with the corresponding expression vectors in a 1:1 ratio. For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 µg DNA. After addition of 540 µl PEI solution was vortexed for 15 s and subsequently incubated for 10 min at room temperature. Afterwards cells were mixed with the DNA/PEI solution, transferred to a 500 ml shake flask and incubated for 3 hours by 37° C. in incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22 µm filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 nM sodium phosphate, 20 mM sodium citrate, 0.5 M sodium chloride, pH 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding 1/10 of 0.5 M sodium phosphate, pH 8. Target protein was concentrated and filtrated prior loading on a HiLoad Superdex 200 column (GE Healthcare equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence. Purity and molecular weight of molecules were analyzed by CE-SDS analyses in the presence and absence of a reducing agent. The Caliper LabChip GXII system (Caliper lifescience) was used according to the manufacturer's instruction. 2 ug sample is used for analyses. The aggregate content of antibody samples is analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

TABLE 5

Production and purification of affinity matured anti-MCSP IgGs

| Construct | Yield [mg/l] | HMW [%] | LMW [%] | Monomer [%] |
|---|---|---|---|---|
| M4-3(C1) ML2(G3) | 43.9 | 0 | 0 | 100 |
| M4-3(C1) ML2(E10) | 59.5 | 0 | 0 | 100 |
| M4-3(C1) ML2(C5) | 68.9 | 0 | 0.8 | 99.2 |

Affinity Determination

ProteOn Analysis

KD was measured by surface plasmon resonance using a ProteOn XPR36 machine (BioRad) at 25° C. with anti-human F(ab')2 fragment specific capture antibody (Jackson ImmunoResearch #109-005-006) immobilized by amine coupling on CM5 chips and subsequent capture of Fabs from bacterial supernatant or from purified Fab preparations. Briefly, carboxymethylated dextran biosensor chips (CM5, GE Healthcare) were activated with N-ethyl-N'-(3-dimethylaminopropyl)-carbodiimide hydrochloride (EDC) and N-hydroxysuccinimide (NHS) according to the supplier's instructions. Anti-human F(ab')2 fragment specific capture antibody was diluted with 10 mM sodium acetate, pH 5.0 at 50 µg/ml before injection at a flow rate of 10 µl/minute to achieve approximately up to 10.000 response units (RU) of coupled capture antibody. Following the injection of the capture antibody, 1 M ethanolamine was injected to block unreacted groups. For kinetics measurements, Fabs from bacterial supernatant or purified Fabs are injected at a flow rate of 10 ul/minute for 300 s and a dissociation of 300 s for capture baseline stabilization. Capture levels were in the range of 100-500 RU. In a subsequent step, human MCSP (D3 domain)-avi-his analyte is injected either as a single concentration or as a concentration series (depending of clone affinity in a range between 100 nM and 250 pM) diluted into HBS-EP-F (GE Healthcare, 10 mM HEPES, 150 mM NaCl, 3 mM EDTA, 0.05% Surfactant P20, pH 7.4) at 25° C. at a flow rate of 50 µl/min. The surface of the sensorchip was regenerated by injection of glycine pH 1.5 for 30 s at 90 ul/min followed by injection of NaOH for 20 s at the same flow rate. Association rates (kon) and dissociation rates (koff) were calculated using a simple one-to-one Langmuir binding model (ProteOn XPR36 Evaluation Software or Scrubber software (BioLogic)) by simultaneously fitting the association and dissociation sensorgrams. The equilibrium dissociation constant (KD) was calculated as the ratio koff/kon. This data was used to determine the comparative binding affinity of the affinity matured variants with the parental antibody. Table 6a shows the data generated from these assays. G3, E10, C5 for the Light Chain, and D6, A7, B7, B8, C1 for the Heavy Chain were chosen for conversion into human IgG1 format. Since CDR1 and 2 of the light chain were randomized independent from CDR3, the obtained CDRs were combined during IgG conversion.

In the IgG format affinities were measured again to the human MCSP antigen (SEQ ID NO. 390), in addition also to the cynomolgus homologue (SEQ ID NO. 389). Method exactly as described for the Fab fragments, just purified IgG from mammalian production were used.

TABLE 6a

MCSP affinity matured clones: Proteon data

| Variant | Human MCSP Fab KD | Human MCSP IgG KD | Cyno MCSP IgG KD | Human MCSP IgG KD Comparative binding affinity - Fold increase over parent | Cyno MCSP IgG KD Comparative binding affinity - Fold increase over parent |
|---|---|---|---|---|---|
| | Proteon generated affinity data | | | | |
| Parental M4-3/ML2 | $5 * 10^{-9}$ | $2 * 10^{-9}$ | $2 * 10^{-9}$ | | |
| M4-3/ML2(G3) | $4 * 10^{-10}$ | $3 * 10^{-10}$ | $6 * 10^{-10}$ | 6.7 | 3.3 |
| M4-3/ML2 (E10) | $7 * 10^{-10}$ | $1 * 10^{-9}$ | $2 * 10^{-9}$ | 2.0 | 1.0 |
| M4-3/ML2 (E10/G3) | | $4 * 10^{-10}$ | $9 * 10^{-10}$ | 5.0 | 2.2 |
| M4-3/ML2 (C5) | $7 * 10^{-10}$ | $4 * 10^{-10}$ | $1 * 10^{-9}$ | 5.0 | 2.0 |
| M4-3/ML2 (C5/G3) | | $7 * 10^{-10}$ | $1 * 10^{-9}$ | 2.9 | 2.0 |
| M4-3(D6)/ML2 | $2 * 10^{-9}$ | $4 * 10^{-10}$ | $1 * 10^{-9}$ | 5.0 | 2.0 |
| M4-3(A7)/ML2 | $2 * 10^{-11}$ | $8 * 10^{-10}$ | $1 * 10^{-9}$ | 2.5 | 2.0 |
| M4-3(B7)/ML2 | | $5 * 10^{-10}$ | $7 * 10^{-10}$ | 4.0 | 2.9 |
| M4-3(B8)/ML2 | $3 * 10^{-10}$ | $9 * 10^{-10}$ | $1 * 10^{-9}$ | 2.2 | 2.0 |
| M4-3(C1)/ML2 | $6 * 10^{-10}$ | $9 * 10^{-10}$ | $8 * 10^{-10}$ | 2.2 | 2.5 |
| M4-3(C1)/ML2(G3) | | $7 * 10^{-11}$ | $2 * 10^{-10}$ | 28.6 | 10.0 |
| M4-3(C1)/ML2(E10) | | $5 * 10^{-10}$ | $6 * 10^{-10}$ | 4.0 | 3.3 |
| M4-3(A7)/ML2(G3) | | $7 * 10^{-11}$ | $2 * 10^{-10}$ | 28.6 | 10.0 |
| M4-3(A7)/ML2(E10) | | $3 * 10^{-10}$ | $7 * 10^{-10}$ | 6.7 | 2.9 |
| M4-3(C1)/ML2(C5) | | $2 * 10^{-10}$ | $3 * 10^{-10}$ | 10.0 | 6.7 |
| M4-3(A7)/ML2(C5) | | $7 * 10^{-11}$ | $2 * 10^{-10}$ | 28.6 | 10.0 |

Affinity Determination by Surface Plasmon Resonance (SPR) using Biacore T200

Surface plasmon resonance (SPR) experiments to determine the affinity and the avidity of the affinity matured IgGs were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

For analyzing the avidity of the interaction of different antiMCSP IgGs to human and cynomolgus MCSP D3 direct coupling of around 9,500 resonance units (RU) of the anti-Penta His antibody (Qiagen) was performed on a CM5 chip at pH 5.0 using the standard amine coupling kit (Biacore, Freiburg/Germany). Antigens were captured for 60 s at 30 nM with 10 µl/min respectively. IgGs were passed at a concentration of 0.0064-100 nM with a flowrate of 30 through the flow cells over 280 s. The dissociation was monitored for 180 s. Bulk refractive index differences were corrected for by subtracting the response obtained on reference flow cell. Here, the IgGs were flown over a surface with immobilized anti-Penta His antibody but on which HBS-EP has been injected rather than human MCSP D3 or cynomolgus MCSP D3.

For affinity measurements IgGs were captured on a CM5 sensorchip surface with immobilized anti human Fc. Capture IgG was coupled to the sensorchip surface by direct immobilization of around 9,500 resonance units (RU) at pH 5.0 using the standard amine coupling kit (Biacore, Freiburg/Germany). IgGs are captured for 25 s at 10 nM with 30 µl/min. Human and cynomolgus MCSP D3 were passed at a concentration of 2-500 nM with a flowrate of 30 µl/min through the flow cells over 120 s. The dissociation is monitored for 60 s. Association and dissociation for concentration 166 and 500 nM was monitored for 1200 and 600 s respectively. Bulk refractive index differences were corrected for by subtracting the response obtained on reference flow cell. Here, the antigens were flown over a surface with immobilized anti-human Fc antibody but on which HBS-EP has been injected rather than anti MCSP IgGs.

Kinetic constants were derived using the Biacore T200 Evaluation Software (vAA, Biacore AB, Uppsala/Sweden), to fit rate equations for 1:1 Langmuir binding by numerical integration.

Higher affinity to human and cynomolgus MCSP D3 were confirmed by surface plasmon resonance measurements using Biacore T200. In addition avidity measurements showed an up to 3 fold increase in bivalent binding (Table 6b).

TABLE 6b

Affinity and avidity of anti MCSP IgGs to human MCSP-D3 and cynomolgus MCSP D3.

| $K_D$ in nM | Human MCSP D3 | | Cynomolgus MCSP D3 | |
|---|---|---|---|---|
| T = 25° C. | Affinity | Avidity | Affinity | Avidity |
| M4-3(C1) ML2(G3) | 1.8 | 0.0045 | 1.4 | 0.0038 |
| M4-3(C1) ML2(E10) | 4.6 | 0.0063 | 3.8 | 0.0044 |
| M4-3(C1) ML2(C5) | 1.8 | 0.0046 | 1.3 | 0.0044 |
| M4-3 ML2 (parental) | 8.6 | 0.0090 | 11.4 | 0.0123 |

Example 11

Preparation of MCSP TCB (2+1 Crossfab-IgG P329G LALA inverted) containing M4-3(C1) ML2(G3) as Anti MCSP Antibody and Humanized CH2527 as anti CD3 Antibody The resulting variable region of heavy and light chain DNA sequences were subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:2:1:1 ratio ("vector heavy chain Fc(hole)":"vector light chain":"vector light chain Crossfab":"vector heavy chain Fc(knob)-FabCrossfab").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 µg DNA. After addition of 540 µl PEI solution was vortexed for 15 s and subsequently incubated for 10 min at room temperature. Afterwards cells were mixed with the DNA/PEI solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22. µm filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 mM sodium phosphate, 20 mM sodium citrate, 0.5 M sodium chloride, pH 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding ¹/₁₀ of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GXII system (Caliper lifescience) was used according to the manufacturer's instruction. 2 ug sample was used for analyses. The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

TABLE 7a

Summary production and purification of MCSP TCB

| Construct | Titer [mg/l] | Yield [mg/l] | Aggregate after 1$^{st}$ purification step [%] | HMW [%] | LMW [%] | Monomer [%] |
|---|---|---|---|---|---|---|
| MCSP TCB | 157 | 0.32 | 32 | 3.3 | 0 | 96.7 |

Figure 68:
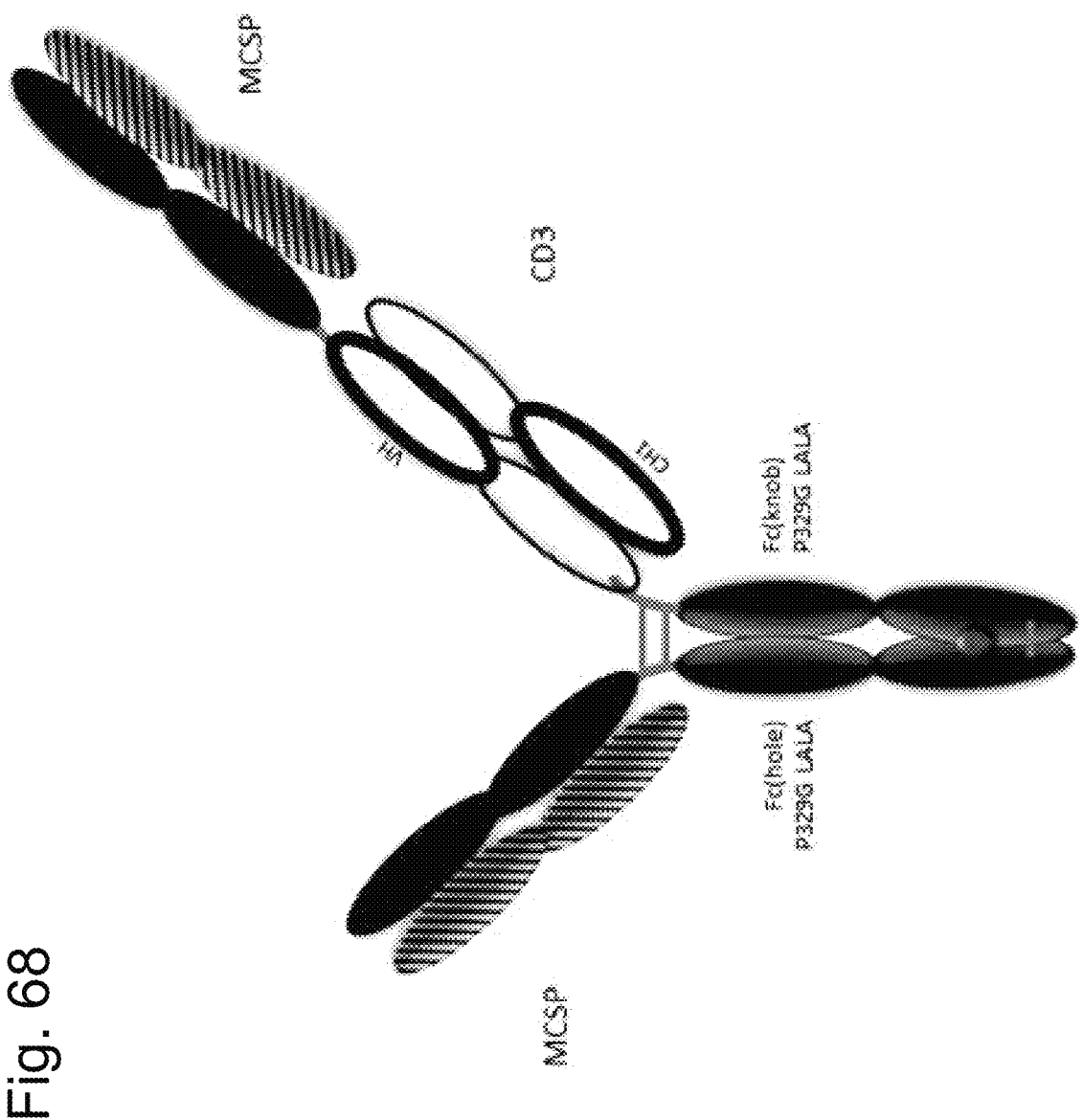
FIG. 68. Schematic drawing of the MCSP TCB (2+1 Crossfab-IgG P329G LALA inverted) molecule.

FIG. 68 shows a schematic drawing of the MCSP TCB (2+1 Crossfab-IgG P329G LALA inverted) molecule.

Figure 69:
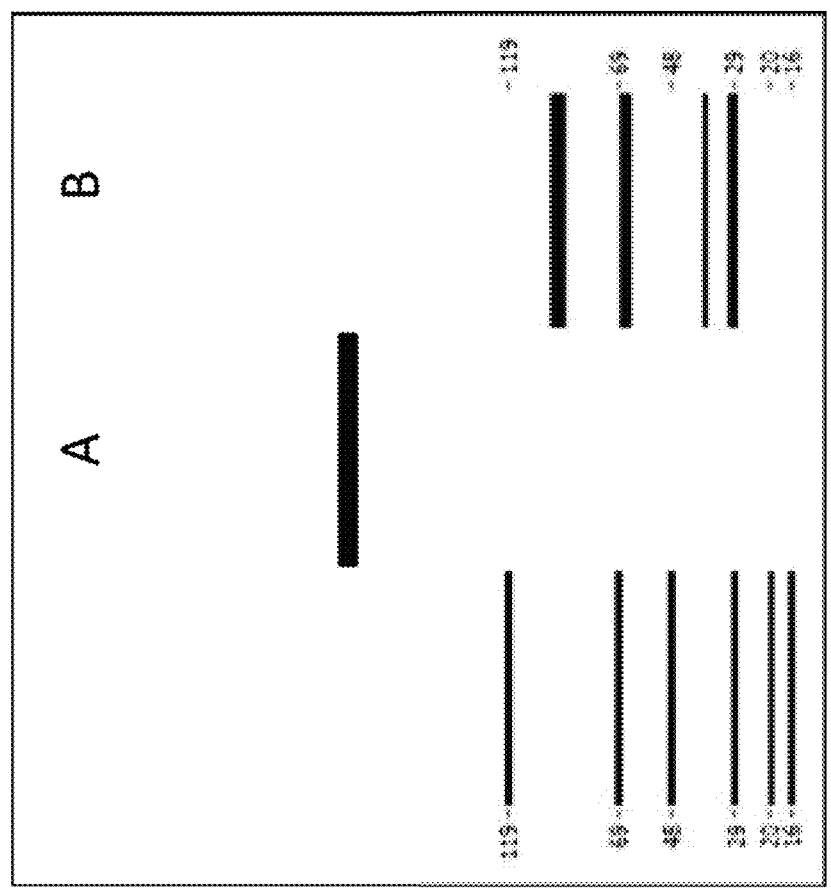
FIG. 69. CE-SDS analyses of MCSP TCB (2+1 Crossfab-IgG P329G LALA inverted, SEQ ID NOs 278, 319, 320, 321). Electropherogram shown as SDS-Page of MCSP TCB: A) non reduced, B) reduced.

FIG. 69 and table 7b show CE-SDS analyses of a MCSP TCB (2+1 Crossfab-IgG P329G LALA inverted) molecule (SEQ ID NOs: 278, 319, 320 and 321).

TABLE 7b

CE-SDS analyses of MCSP TCB

| | Peak | kDa | Corresponding Chain |
|---|---|---|---|
| MCSP TCB non reduced (A) | 1 | 206.47 | |
| MCSP TCB reduced (B) | 1 | 29.15 | Light chain ML2 (C1) |
| | 2 | 37.39 | Light chain huCH2527 |
| | 3 | 66.07 | Fc(hole) |
| | 4 | 94.52 | Fc(knob) |

Figure 70:
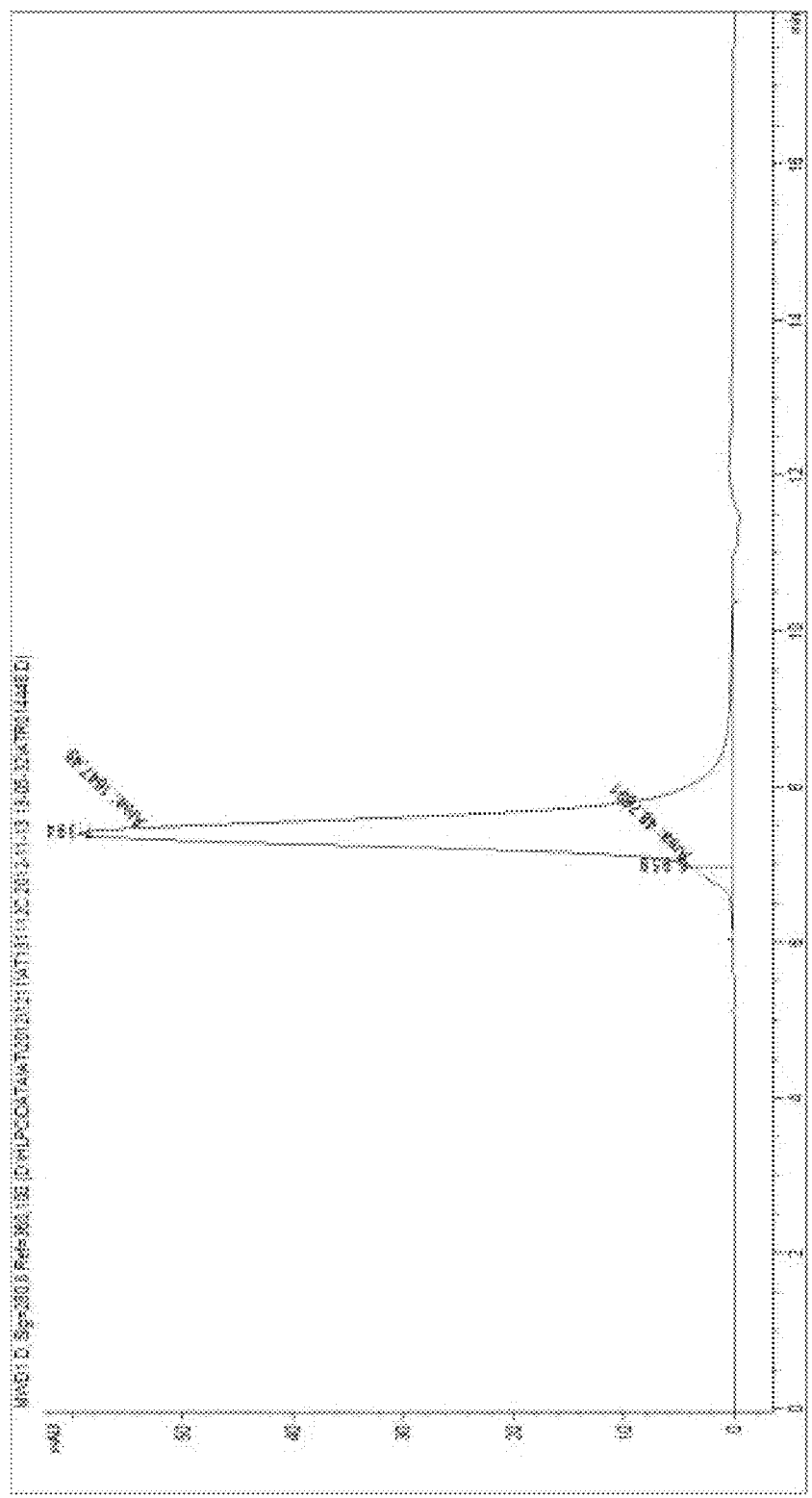
FIG. 70. Analytical size exclusion chromatography of MCSP TCB (2+1 Crossfab-IgG P329G LALA inverted, SEQ ID NOs 278, 319, 320, 321), Chromatogram A280 (TSKgel G3000 SW XL [Tosoh]; 25 mM K2HPO4, 125 mM NaCl, 200 mM L-Arginine Monohydrochloride, 0.02. % NaN3, pH 6.7; 20 ug sample were injected.

FIG. 70 shows analytical size exclusion chromatography of a MCSP TCB (2+1 Crossfab-IgG P329G LALA inverted) molecule (SEQ ID NOs: 78, 319, 320 and 321).

Example 12

Preparation of CEA TCB (2+1 Crossfab-IgG P329G LALA inverted) Containing CH1A1A 98/99 2F1 as Anti CEA Antibody and Humanized CH2527 as Anti CD3 Antibody The resulting variable region of heavy and light chain DNA sequences were subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:2:1:1 ratio ("vector heavy chain Fc(hole)":"vector light chain":"vector light chain Crossfab":"vector heavy chain Fc(knob)-FabCrossfab").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 µg DNA. After addition of 540 µl PEI solution was vortexed for 15 s and subsequently incubated for 10 min at room temperature. Afterwards cells were mixed with the DNA/PET solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7 (4) Feed 1 was added. After 7 days cultivation supernatant was collected for purification by centrifugation for 15 min at 210×g, the solution was sterile filtered (0.22·m filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 mM sodium phosphate, 20 mM sodium citrate, 0.5 M sodium chloride, pH 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding 1/10 of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GXII system (Caliper lifescience) was used according to the manufacturer's instruction. 2 ug sample was used for analyses.

The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

TABLE 8

Summary production and purification of CEA TCB

| Construct | Titer [mg/l] | Yield [mg/l] | Aggregate after 1$^{st}$ purification step [%] | HMW [%] | LMW [%] | Monomer [%] |
|---|---|---|---|---|---|---|
| CEA TCB | 66 | 0.31 | 21.5 | 8.1 | 4.4 | 87.5 |

Figure 71:
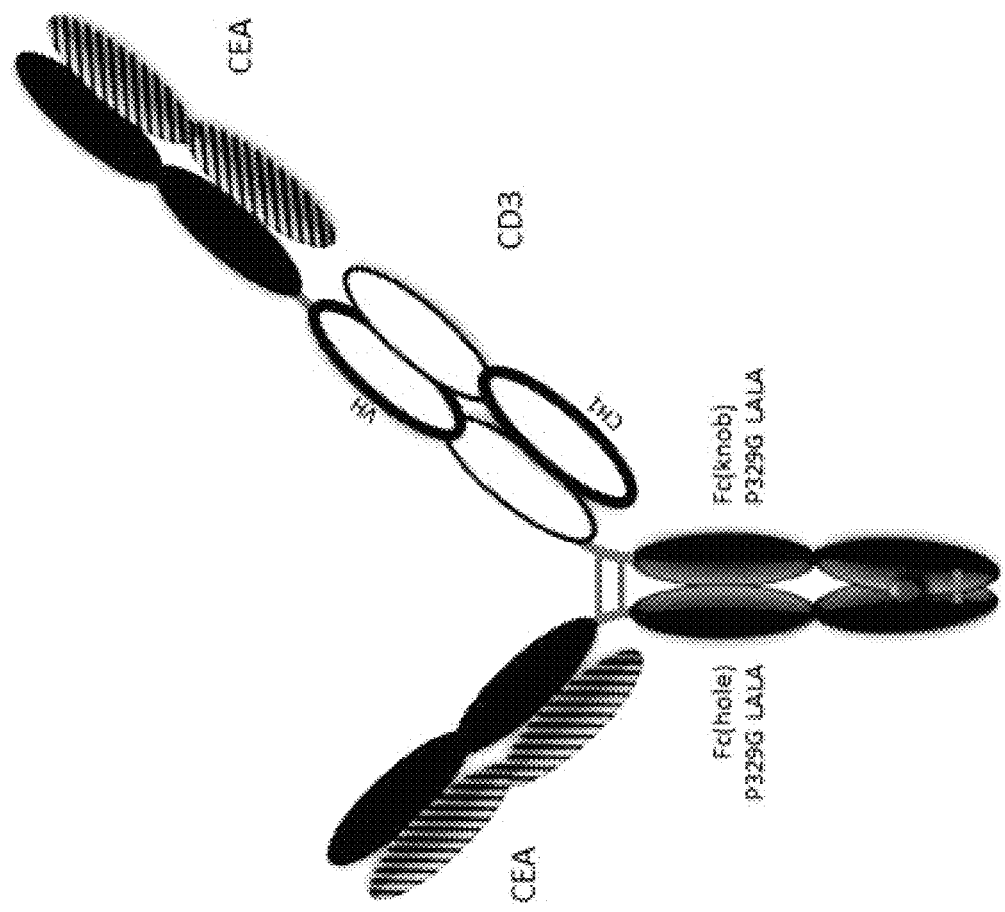
FIG. 71. Schematic drawing of CEA TCB (2+1 Crossfab-IgG P329G LALA inverted) molecule.

FIG. 71 shows a schematic drawing of CEA TCB (2+1 Crossfab-IgG P329G LALA inverted) molecule.

Figure 72:
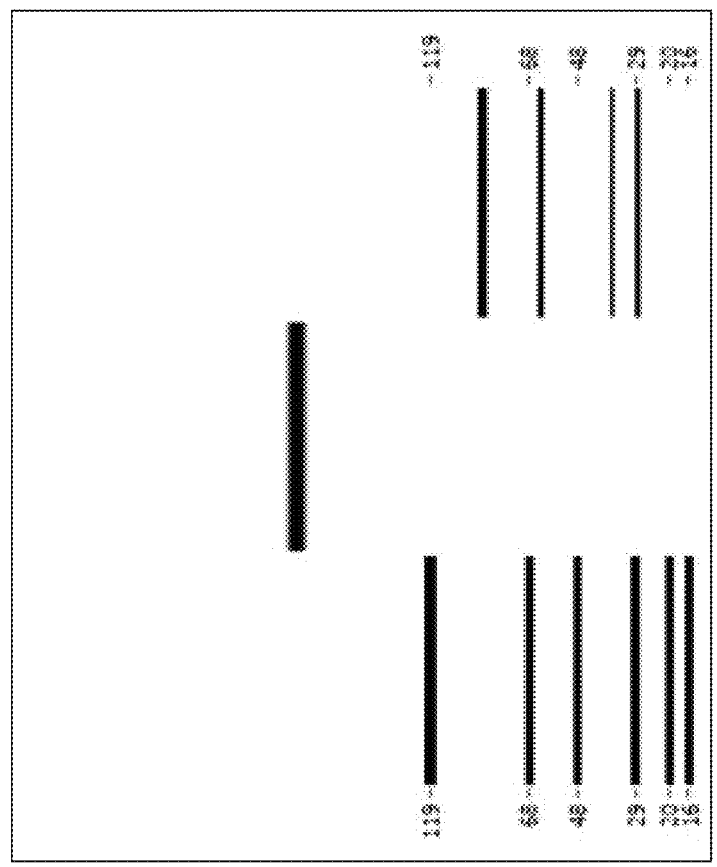
FIG. 72. CE-SDS analyses of CEA TCB (2+1 Crossfab-IgG P329G LALA inverted, SEQ ID NOs 288, 322, 323, 324)) molecule. Electropherogram shown as SDS-Page of CEA TCB.

FIG. 72 and table9 show CE-SDS analyses of a CEA TCB (2+1 Crossfab-IgG P329G LALA inverted) molecule (SEQ ID NOs: 288, 322, 323 and 324).

TABLE 9

CE-SDS analyses of CEA TCB

| | Peak | kDa | Corresponding Chain |
|---|---|---|---|
| CEA TCB non reduced (A) | 1 | 205.67 | Correct molecule |
| CEA TCB reduced (B) | 1 | 28.23 | Light chain CH1A1A 98/99 × 2F1 |
| | 2 | 36.31 | Light chain CH2527 |
| | 3 | 63.48 | Fc(hole) |
| | 4 | 90.9 | Fc(knob) |

Figure 73:
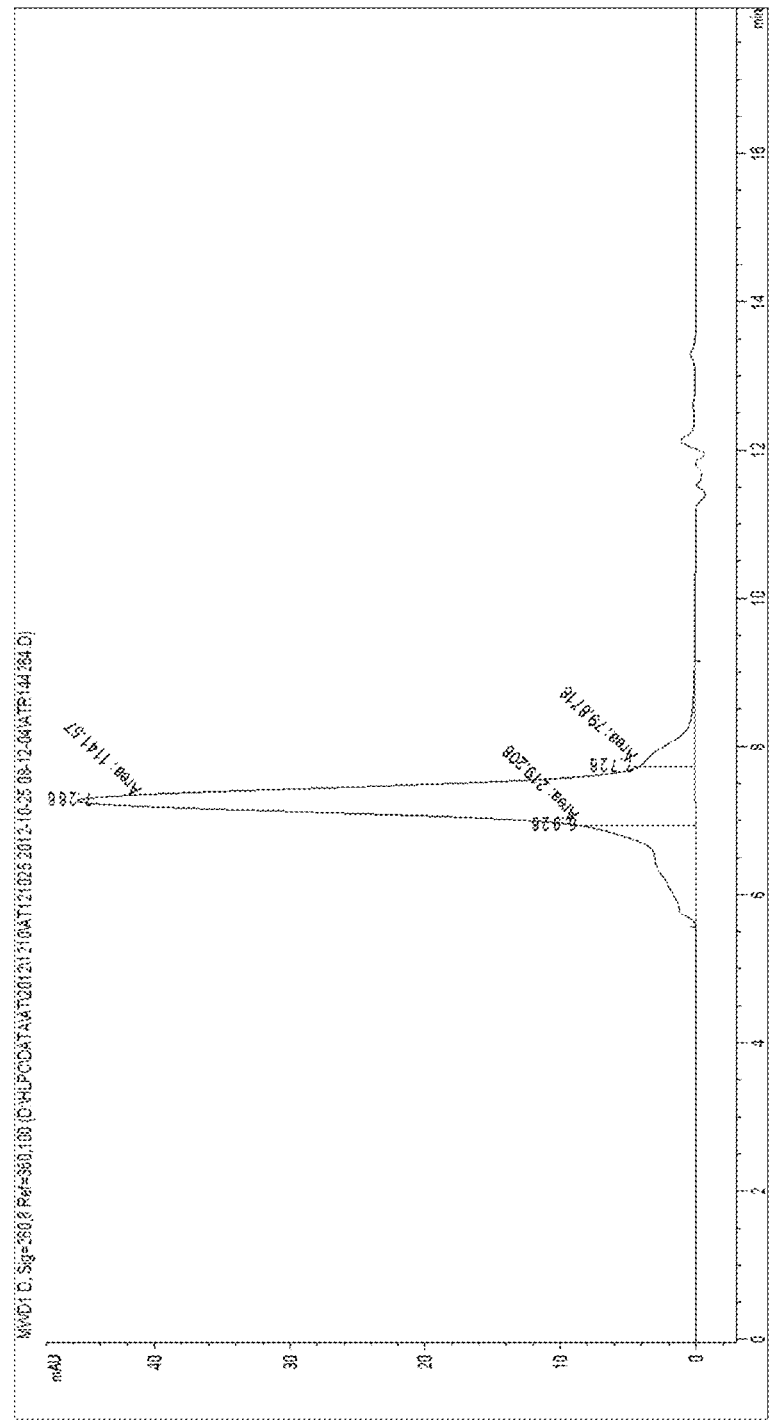
FIG. 73. Analytical size exclusion chromatography of CEA TCB (2+1 Crossfab-IgG P329G LALA inverted SEQ ID NOs 288, 322, 323, 324)) molecule, Chromatogram A280 (TSKgel G3000 SW XL [Tosoh]; 25 mM K2HPO4, 125 mM NaCl, 200 mM L-Arginine Monohydrochloride, 0.02% (w/v) NaN3, pH 6.7; 20 ug sample were injected FIGS. 74A and 74B. Binding of MCSP TCB (SEQ ID NOs 278, 319, 320, 321) to A375 cells (MCSP+) (FIG. 74A) and Jurkat (CD3+ cells) (FIG. 74B). "Untargeted TCB": bispecific antibody engaging CD3 but no second antigen.

FIG. 73 shows analytical size exclusion chromatography of a CEA TCB (2+1 Crossfab-IgG P329G LALA inverted) molecule (SEQ ID NOs: 288, 322, 323 and 324).

Example 13

Binding of GA903 TCB to MCSP- and CD3-expressing Cells

Figure 74B:
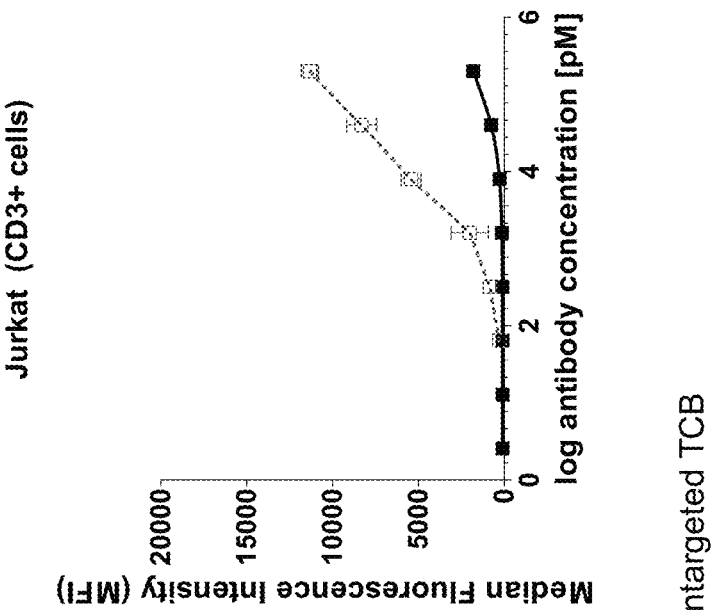
Figure 74A:
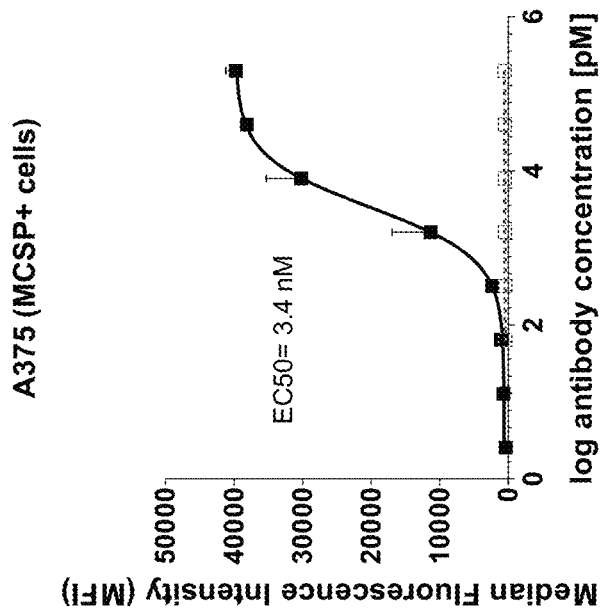
Figure 75A:
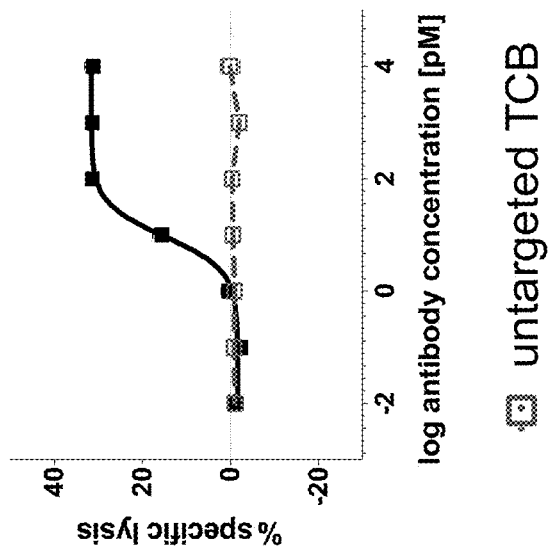
FIGS. 75A-75D. T-cell killing induced by MCSP TCB antibody (SEQ CD NOs 278, 319, 320, 321) of A375 (high MCSP) (FIG. 75A), MV-3 (medium MCSP) (FIG. 75B), HCT-116 (low MCSP) (FIG. 75C) and LS180 (MCSP negative) (FIG. 75D) target cells (E:T=10:1, effectors human PBMCs, incubation time 24 h). "Untargeted TCB": bispecific antibody engaging CD3 but no second antigen.
Figure 75B:
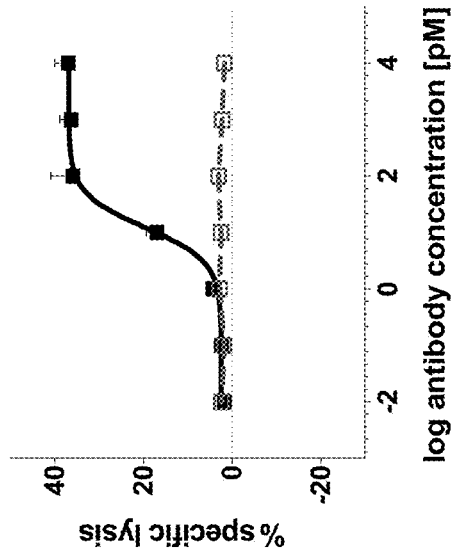
Figure 75D:
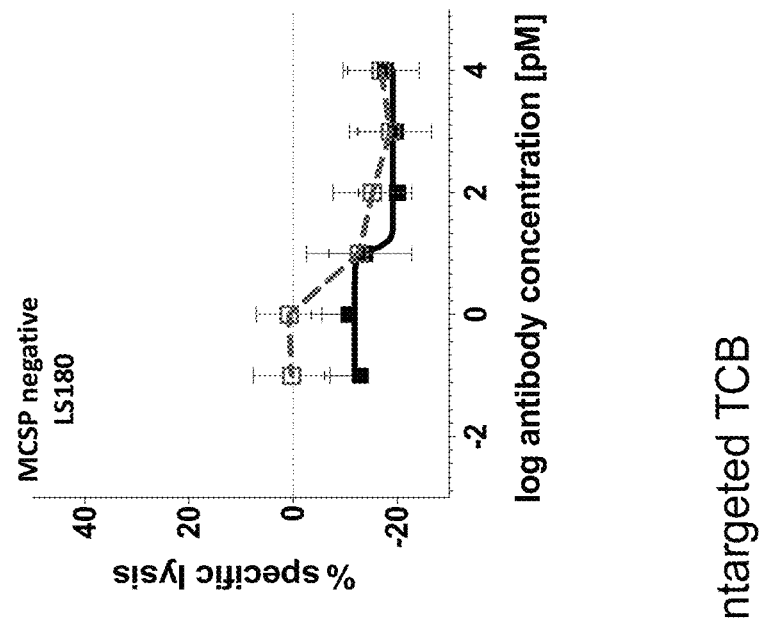
Figure 75C:
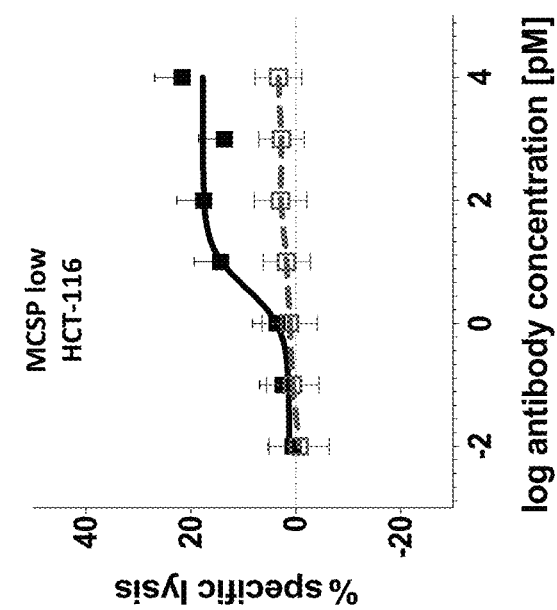
Figure 76A:
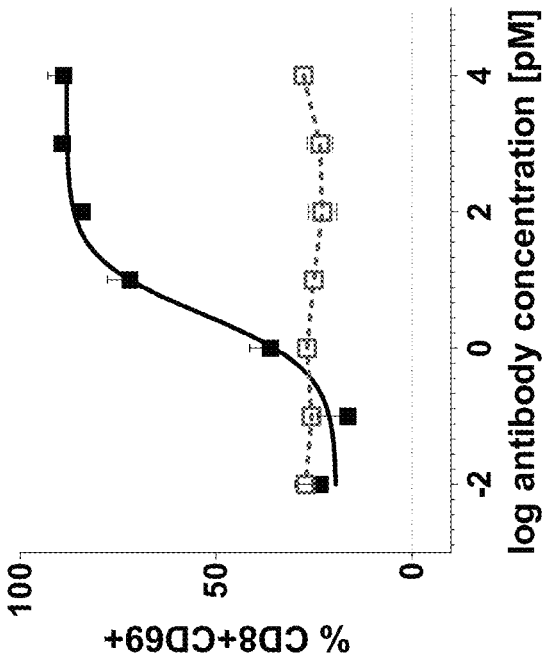
FIGS. 76A-76D. Upregulation of CD25 and CD69 on human CD8+ (FIG. 76A, FIG. 76B) and CD4+ (FIG. 76C, FIG. 76D) T cells after T cell-mediated killing of MV3 melanoma cells (E:T=10:1, 24 h incubation) induced by MCSP TCB antibody (SEQ ID NOs 278, 319, 320, 321). "Untargeted TCB": bispecific antibody engaging CD3 but no second antigen.
Figure 76B:
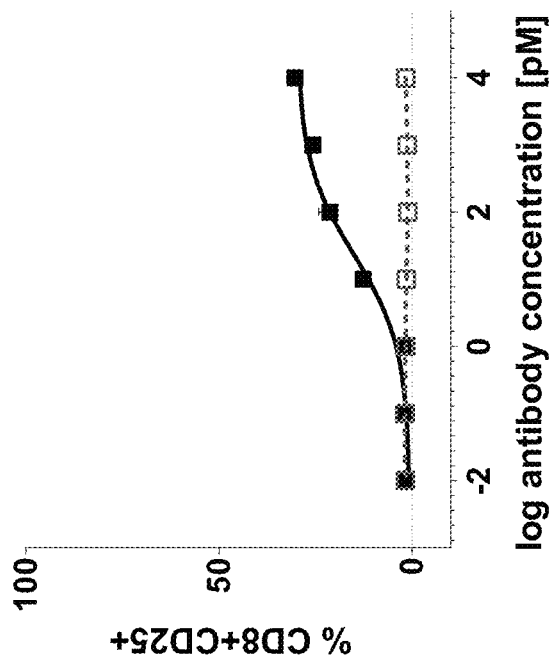
Figure 76D:
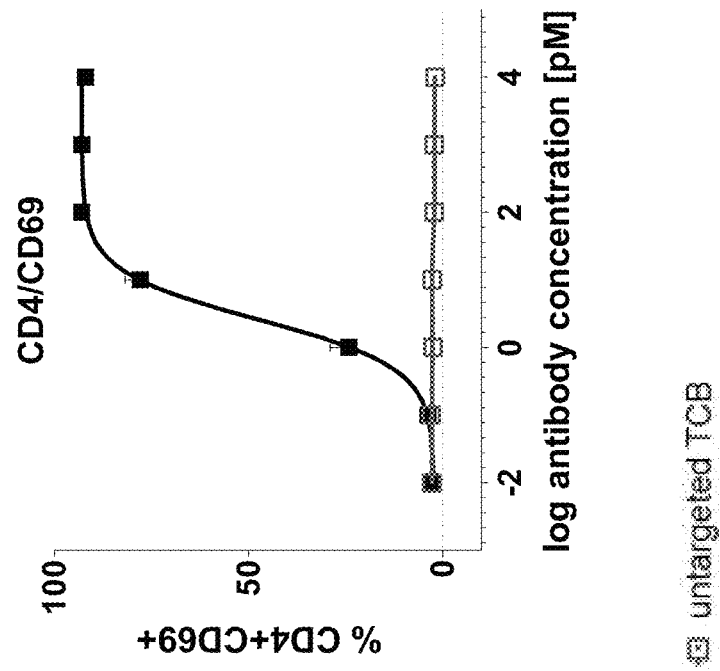
Figure 76C:
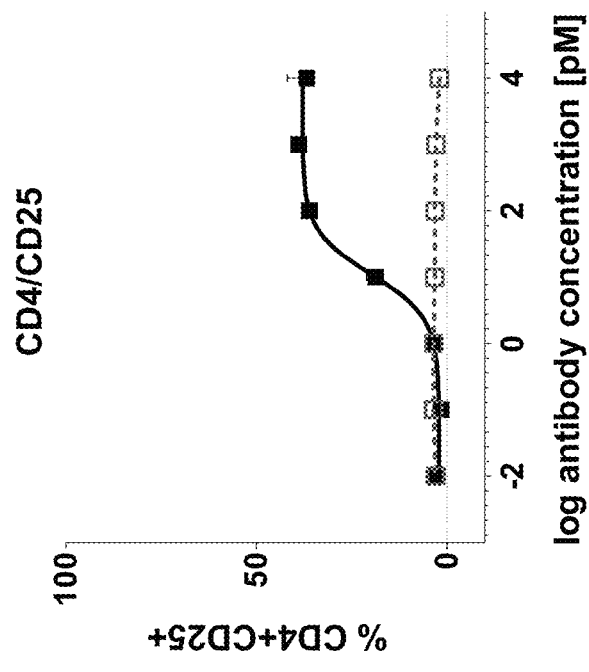

The binding of GA903 TCB was tested on MCSP-expressing human malignant melanoma cell line (A375) and CD3-expressing immortalized T lymphocyte line (Jurkat). Briefly, cells were harvested, counted, checked for viability and resuspended at 2×106 cells/ml in FACS buffer (100 µl PBS 0.1% BSA). 100 µl of cell suspension (containing 0.2×106 cells) were incubated in round-bottom 96-well plate for 30 min at 4° C. with increasing concentrations of the MCSP TCB (2.6 pM-200 nM), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva) by gating live, DAPI-negative, cells. Binding curves were obtained using GraphPadPrism5 (FIG. 74 panel A, binding to A375 cells. EC50=3381 pM; FIG. 74 panel B binding to Jurkat cells).

Example 14

T-Cell Killing Induced by MCSP TCB Antibody

I-cell killing mediated by MCSP TCB antibody assessed using a panel of tumor cell lines expressing different levels of MCSP (A375=MCSP high, MV-3=MSCP medium, HCT-116=MCSP low, LS180=MCSP negative). Briefly, target cells were harvested with Trypsin/EDTA, washed, and plated at density of 25,000 cells/well using flat-bottom 96-well plates. Cells were left to adhere overnight. Peripheral blood mononuclear cells (PBMCs) were prepared by Histopaque density centrifugation of enriched lymphocyte preparations (buffy coats) obtained from healthy human donors. Fresh blood was diluted with sterile PBS and layered over Histopaque gradient (Sigma, #H8889). After centrifugation (450×g, 30 minutes, room temperature), the plasma above the PBMC-containing interphase was discarded and PBMCs transferred in a new falcon tube subsequently filled with 50 ml of PBS. The mixture was centrifuged (400×g, 10 minutes, room temperature), the supernatant discarded and the PBMC pellet washed twice with sterile PBS (centrifugation steps 350×g, 10 minutes). The resulting PBMC population was counted automatically (ViCell) and stored in RPMI1640 medium containing 10% FCS and 1% L-alanyl-L-glutamine (Biochrom, K0302) at 37° C., 5% CO2 in cell incubator until further use (no longer than 24 h). For the killing assay, the antibody was added at the indicated concentrations (range of 1 pM-10 nM in triplicates). PBMCs were added to target cells at final E:T ratio of 10:1. Target cell killing was assessed after 24 h of incubation at 37° C., 5% $CO_2$ by quantification of LDH released into cell supernatants by apoptotic/necrotic cells (LDH detection kit, Roche Applied Science, #11 644 793 001). Maximal lysis of the target cells (=100%) was achieved by incubation of target cells with 1% Triton X-100. Minimal lysis (=0%) refers to target cells co-incubated with effector cells without bispecific construct. The results show that MCSP TCB induced a strong and target-specific killing of MCSP+ target cell lines with no killing of MCSP-cell lines, FIG. 75 panels A-D. The EC50 values related to killing assays, calculated using GraphPadPrism5 are given in Table 10.

TABLE 10

EC50 values (pM) for T-cell mediated killing of MCSP-expressing tumor cells induced by MCSP TCB antibody.

| Cell line | MCSP receptor copy number | EC50 [pM] |
|---|---|---|
| A375 | 387 058 | 12.3 |
| MV-3 | 260 000 | 9.4 |
| HCT-116 | 36770 | 3.7 |
| LS180 | Negative | n.d. |

Example 15

CD25 and CD69 Upregulation on CD8+ and CD4+ Effector Cells after T Cell-Killing of MCSP-Expressing Tumor Cells Induced by MCSP TCB Antibody Activation of $CD8^+$ and $CD4^+$ T cells after T-cell killing of MCSP-expressing MV-3 tumor cells mediated by the MCSP TCB antibody was assessed by FACS analysis using antibodies recognizing the T cell activation markers CD25 (late activation marker) and CD69 (early activation marker). The antibody and the killing assay conditions were essentially as described above (Example 14), using the same antibody concentration range (1 pM-10 nM in triplicates), E:T ratio 10:1 and an incubation time 24 h.

After the incubation, PBMCs were transferred to a round-bottom 96-well plate, centrifuged at 350×g for 5 min and washed twice with PBS containing 0.1% BSA. Surface staining for CD8 (FITC anti-human CD8 BD #555634), CD4 (PECy7 anti-human CD4, BD #557852), CD69 (PE anti-human CD69 Biolegend #310906) and CD25 (APC anti-human CD25 BD #555434) was performed according to the suppliers' indications. Cells were washed twice with 150 μl/well PBS containing 0.1% BSA and fixed for 15 min at 4° C. using 100 fixation buffer (BD #554655). After centrifugation, the samples were resuspended in 200 μl/well PBS 0.1% BSA containing DAPI to exclude dead cells for the FACS measurement. Samples were analyzed at BD FACS Fortessa. The results show that MCSP TCB induced a strong and target-specific upregulation of activation markers (CD25, CD69) on CD8+ T cells (FIG. 76 panels A, B) and CD4+ T cells (FIG. 76 panels C, D) after killing.

Example 16

Cytokine Secretion by Human Effector Cells after T Cell-Killing of MCSP-Expressing Tumor Cells Induced by MCSP TCB Antibody Cytokine secretion by human PBMCs after T-cell killing of MCSP-expressing MV-3 tumor cells induced by the MCSP TCB antibody was assessed by FACS analysis of cell supernatants after the killing assay.

The same antibody was used and the killing assay was performed essentially as described above (Example 14 and 15), using an E:T ratio of 10:1 and an incubation time of 24 h.

At the end of the incubation time, the plate was centrifuged for 5 min at 350×g, the supernatant transferred in a new 96-well plate and stored at −20° C. until subsequent analysis. Granzyme B, TNFα, IFN-γ, IL-2, IL-4 and IL-10 secreted into in cell supernatants were detected using the BD CBA Human Soluble Protein Flex Set, according to manufacturer's instructions on a FACS CantoII. The following kits were used: BD CBA human Granzyme B BD CBA human Granzyme B Flex Set #BD 560304; BD CBA human TNT Flex Set #BD #558273; BD CBA human IFN-γ Flex Set #BD #558269; BD CBA human IL-2 Flex Set #BD #558270; BD CBA human IL-4 Flex Set #BD #558272; CBA human IL-10 Flex Set #BD #558274.

Figure 77D:
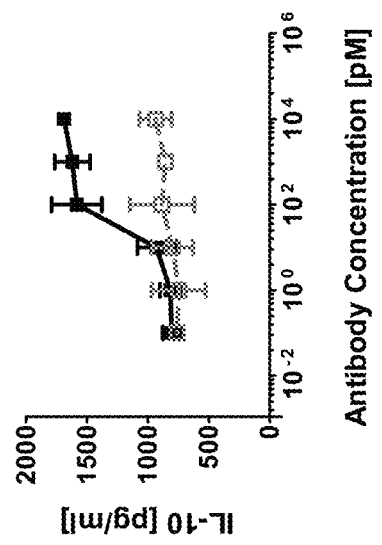
Figure 77E:
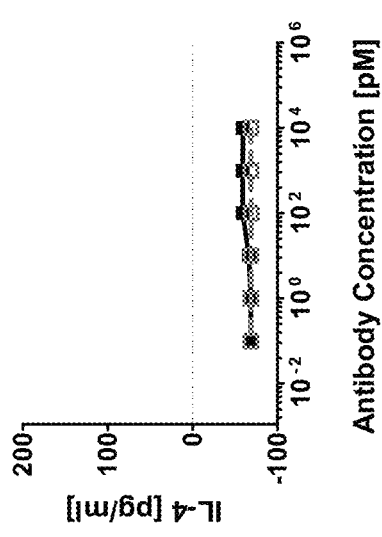
Figure 77F:
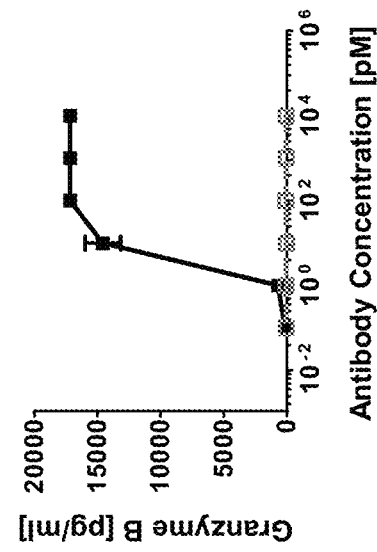

The results show that MCSP TCB induced secretion of IL-2, IFN-γ, TNFα, Granzyme B and IL-10 (but no IL-4) upon killing, FIG. 77 panels A-F.

These examples show that the MCSP CD3 bispecific antibody
  Showed a good binding to MCSP+ A375 cells
  Induced a strong and target-specific killing of MCSP-F target cell lines, and no killing of MCSP-cell lines
  Induced a strong and target-specific upregulation of activation markers (CD25, CD69) on CD8+ and CD4+ T cells after killing
  Induced secretion of IL-2, IFN-g, TNF-a, GrB and IL-10 (no IL-4) upon killing Example 17

Binding of CEA TCB to CEA- and CD3-Expressing Cells

Figure 78B:
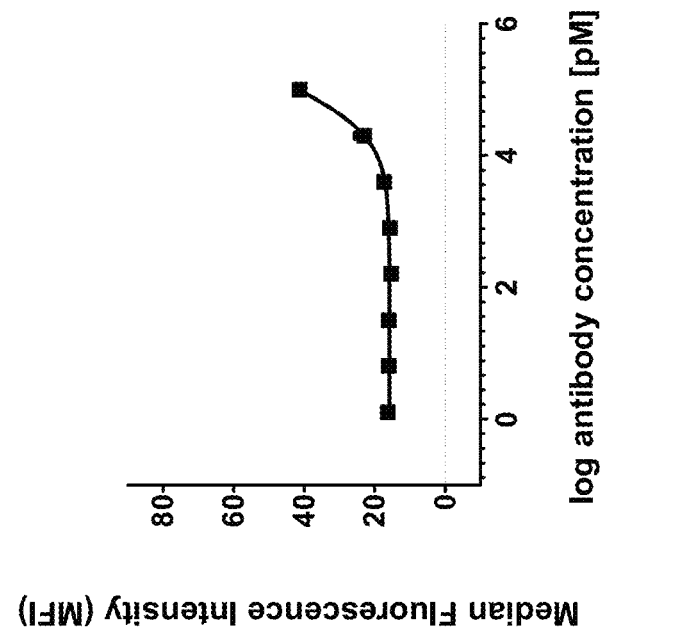
FIGS. 78A and 78B. Binding of CEA TCB (SEQ ID NOs 288, 322, 323, 324) to LS180 (medium CEA tumor cells) (FIG. 78A) and Jurkat (CD3+ cells) (FIG. 78B).
Figure 78A:
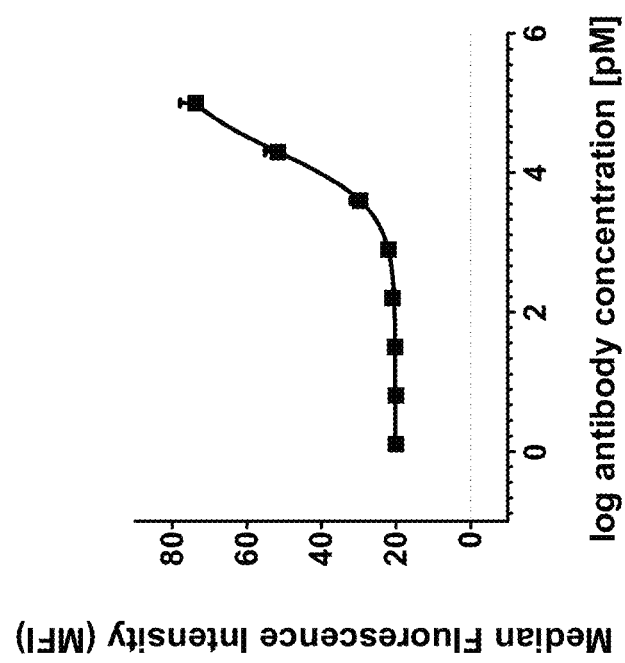

The binding of CEA TCB was tested on CEA-expressing colon adenocarcinoma cells (LS180) and CD3-expressing immortalized T lymphocyte line (Jurkat). Briefly, cells were harvested, counted, checked for viability and resuspended at 2×106 cells/ml in FACS buffer (100 μl PBS 0.1% BSA), 100 μl of cell suspension (containing $0.2 \times 10^6$ cells) were incubated in round-bottom 96-well plate for 30 min at 4° C. with increasing concentrations of the CEA TCB (3 pM-200 nM), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva) by gating live, DAPI-negative, cells. Binding curves were obtained using GraphPadPrism5 (FIG. 78 panel A, binding to LS180 cells; FIG. 78 panel B, binding to Jurkat cells).

Example 18

T-Cell Killing Induced by CEA TCB Antibody

T-cell killing mediated by CEA TCB antibody assessed on MKN45 (high CEA), LS180 (medium CEA) and HT-29 (low CEA) human tumor cells. Human PBMCs were used as effectors and the killing was detected at 24 h of incubation with the bispecific antibody. Briefly, target cells were harvested with Trypsin/EDTA, washed, and plated at density of 25,000 cells/well using flat-bottom 96-well plates. Cells were left to adhere overnight. Peripheral blood mononuclear cells (PBMCs) were prepared by Histopaque density centrifugation of enriched lymphocyte preparations (huffy coats) obtained from healthy human donors. Fresh blood was diluted with sterile PBS and layered over Histopaque gradient (Sigma, #H8889). After centrifugation (450×g, 30 minutes, room temperature), the plasma above the PBMC-containing interphase was discarded and PBMCs transferred in a new falcon tube subsequently filled with 50 ml of PBS. The mixture was centrifuged (400×g, 10 minutes, room temperature), the supernatant discarded and the PBMC pellet washed twice with sterile PBS (centrifugation steps 350×g, 10 minutes). The resulting PBMC population was counted automatically (ViCell) and stored in RPMI1640 medium containing 10% FCS and 1% L-alanyl-L-glutamine (Biochrom, K0302) at 37° C., 5% CO2 in cell incubator until further use (no longer than 24 h). For the killing assay, the antibody was added at the indicated concentrations (range of 0.2 pM-20 nM in triplicates). PBMCs were added to target cells at final E:T ratio of 10:1. Target cell killing was assessed after 24 h and 48 h of incubation at 37° C., 5% $CO_2$ by quantification of LDH released into cell supernatants by apoptotic/necrotic cells (LDH detection kit, Roche Applied Science, #11 644 793 001). Maximal lysis of the target cells (=100%) was achieved by incubation of target cells with 1% Triton X-100. Minimal lysis (=0%) refers to target cells co-incubated with effector cells without bispecific construct. The results show that CEA TCB induced a strong and target-specific killing of CEA+ target cell lines, FIG. 79 panels A-C. The EC50 values related to killing assays, calculated using GraphPadPrism5 are given in Table 11.

TABLE 11

EC50 values (pM) for T-cell mediated killing of CEA-expressing tumor cells induced by CEA TCB antibody.

| Cell line | CEA receptor copy number | EC50 [pM] 24 h |
|---|---|---|
| MKN45 | 280 000 | 95 |
| LS180 | 92 000 | 560 |
| HT-29 | 3000 | n.d |

Example 19

CD25 and CD69 Upregulation on CD8+ and CD4+ Effector Cells after T Cell-Killing of CEA-Expressing Tumor Cells Induced by CEA TCB Antibody Activation of $CD8^+$ and $CD4^+$ T cells after T-cell killing of CEA-expressing LS180 tumor cells mediated by the CEA TCB antibody was assessed by FACS analysis using antibodies recognizing the T cell activation markers CD25 (late activation marker) and CD69 (early activation marker). The antibody and the killing assay conditions were essentially as described above (Example 18), using the same antibody concentration range (0.2 pM-20 nM in triplicates), E:T ratio 10:1 and an incubation time 24 h.

Figure 80D:
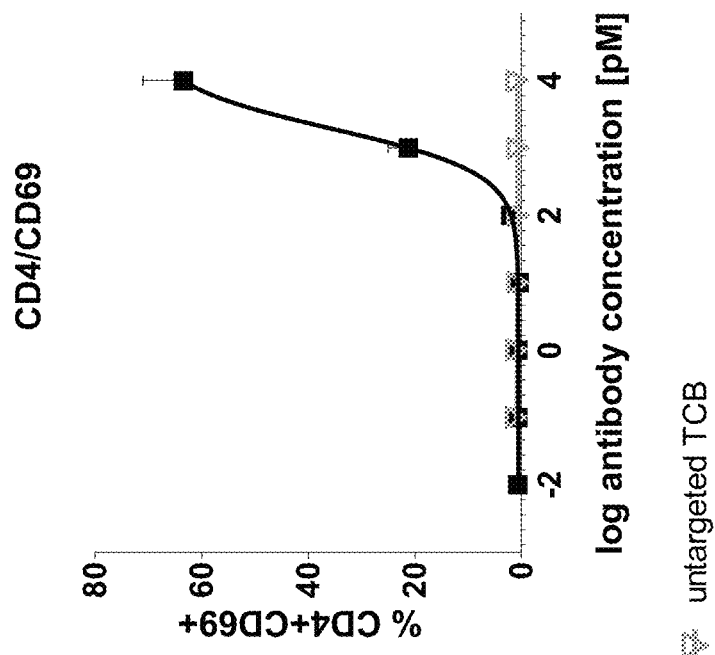
Figure 80C:
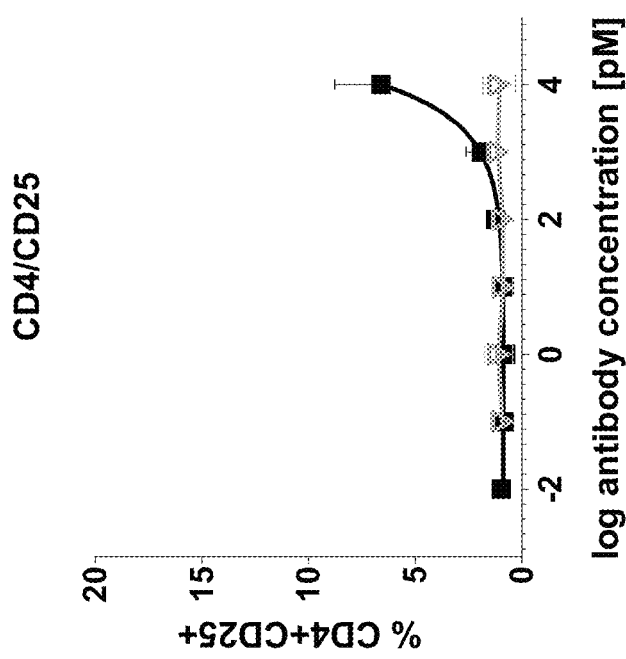
Figure 81A:
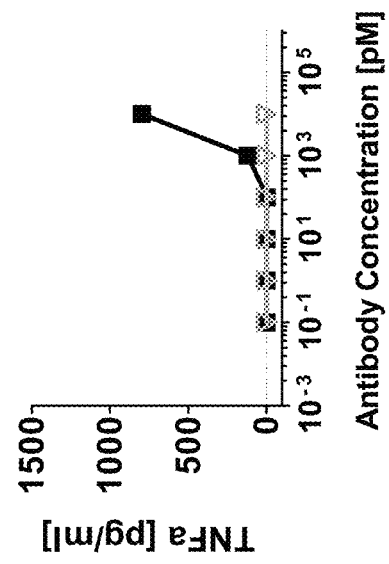
FIGS. 81A-81E. Secretion of IFN-γ (FIG. 81A), TNFα (FIG. 81B), Granzyme B (FIG. 81C), IL-4 (FIG. 81D), IL-10 (FIG. 81E) after T cell mediated killing of LS180 colon adenocarcinoma cells (E:T=10:1, 24 h incubation) induced by CEA TCB (SEQ ID NOs 288, 322, 323, 324) "Untargeted TCB": bispecific antibody engaging CD3 but no second antigen.
Figure 81B:
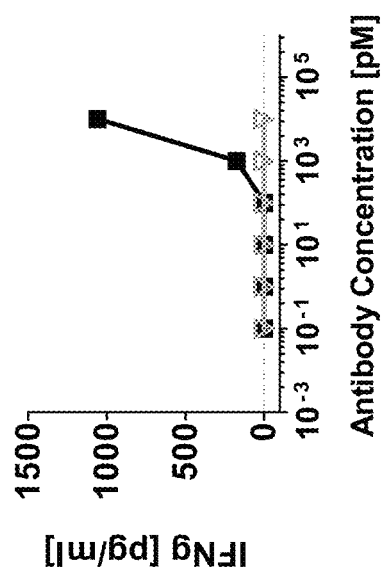
Figure 81C:
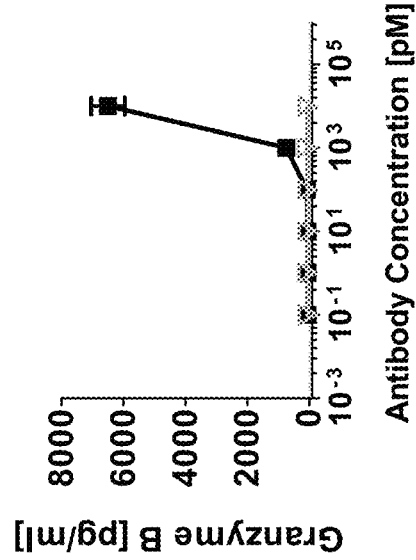
Figure 81D:
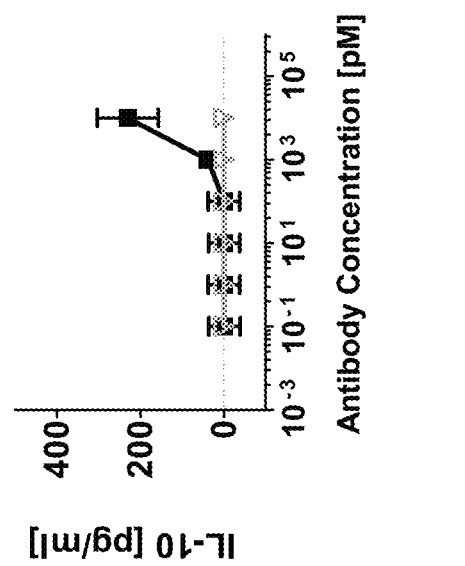
Figure 81E:
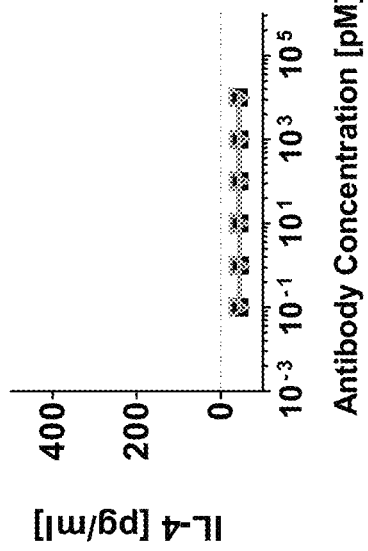

After the incubation, PBMCs were transferred to a round-bottom 96-well plate, centrifuged at 350×g for 5 min and washed twice with PBS containing 0.1% BSA. Surface staining for CD8 (FITC anti-human CD8 BD #555634), CD4 (PECy7 anti-human CD4, BD #557852), CD69 (PE anti-human CD69 Biolegend #310906) and CD25 (APC anti-human CD25 BD #555434) was performed according to the suppliers' indications. Cells were washed twice with 150 µl/well PBS containing 0.1% BSA and fixed for 15 min at 4° C. using 100 µl/well fixation buffer (BD #554655). After centrifugation, the samples were resuspended in 200 µl/PBS 0.1% BSA containing DAPI to exclude dead cells for the FACS measurement. Samples were analyzed at BD FACS Fortessa. The results show that CEA TCB induced a strong and target-specific upregulation of activation markers (CD25, CD69) on CD8+(FIG. 80 panels A, B) and CD4+ T cells (FIG. 80 panels C, D) after killing.

Example 20

Cytokine Secretion by Human Effector Cells after T Cell-Killing of CEA-Expressing Tumor Cells Induced by CEA TCB Cytokine secretion by human PBMCs after T-cell killing of CEA-expressing LS180 tumor cells induced by the CEA TCB was assessed by FACS analysis of cell supernatants after the killing assay. The same antibody was used and the killing assay was performed essentially as described above (Example 18 and 19), using an E:T ratio of 10:1 and an incubation time of 24 h.

At the end of the incubation time, the plate was centrifuged for 5 min at 350×g, the supernatant transferred in a new 96-well plate and stored at −20° C. until subsequent analysis. Granzyme B, IFN-γ; IL-4 and IL-10 secreted into in cell supernatants were detected using the BD CBA Human Soluble Protein Flex Set, according to manufacturer's instructions on a FACS CantoII. The following kits were used: BD CBA human Granzyme B BD CBA human Granzyme B Flex Set #BD 560304; BD CBA human TNF Flex Set #BD #558273; BD CBA human IFN-γ Flex Set #BD #558269; BD CBA human IL-4 Flex Set #BD #558272; BD CBA human IL-10 Flex Set #BD #558274.

The results show that CEA TCB induced secretion of IFN-γ, TNFα, Granzyme 13, IL-4 and IL-10 upon killing, FIG. 81 panels A-E.

These examples show that the CEA CD3 bispecific antibody

Showed a good binding to CEA+ cells

Induced a strong and target-specific killing of CEA+ target cell lines.

Induced a strong and target-specific upregulation of activation markers (CD25, CD69) on CD8+ and CD4+ T cells after killing Induced secretion of IL-2, IFN-g, TNF-a, GrB and IL-10 (no IL-4) upon killing Example 21

Preparation of DP47 GS TCB (2+1 Crossfab-IgG P329G LALA Inverted="Untargeted TCB") Containing DP47 GS as Non Binding Antibody and Humanized CH2527 as Anti CD3 Antibody The "untargeted TCB" was used as a control in the above experiments. The bispecific antibody engages CD3e but does not bind to any other antigen and therefore cannot crosslink T cells to any target cells (and subsequently cannot induce any killing). It was therefore used as negative control in the assays to monitor any unspecific T cell activation.

The resulting variable region of heavy and light chain DNA sequences have been subcloned in frame with either the constant heavy chain or the constant light chain pre-inserted into the respective recipient mammalian expression vector. The antibody expression is driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:2:1:1 ratio ("vector heavy chain Fc(hole)":"vector light chain":"vector light chain Crossfab":"vector heavy chain Fc(knob)-FabCrossfab").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant is replaced by pre-warmed 20 ml CD CHO medium. Expression vectors were mixed in 20 ml CD CHO medium to a final amount of 200·g DNA. After addition of 540 µl PEI solution was vortexed for 15 s and subsequently incubated for 10 min at room temperature. Afterwards cells were mixed with the DNA/PEI solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22·m filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 2.0 mM sodium citrate, 0.5 M sodium chloride, pH 7.5. Unbound protein was removed by washing with at least 10 column volume 20 mM sodium phosphate, 20 mM sodium citrate, 0.5 M sodium chloride, 7.5. Target protein was eluted during a gradient over 20 column volume from 20 mM sodium phosphate, 0.5 M sodium chloride, pH 7.5 to 20 mM sodium citrate, 0.5 M sodium chloride, pH 2.5. Protein solution was neutralized by adding ¹/₁₀ of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GXII system (Caliper lifescience) was used according to the manufacturer's instruction. 2 ug sample is used for analyses.

The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

TABLE 12

Summary production and purification of DP47 GS TCB

| Construct | Titer [mg/l] | Yield [mg/l] | Aggregate after 1$^{st}$ purification step [%] | HMW [%] | LMW [%] | Monomer [%] |
|---|---|---|---|---|---|---|
| DP47 GS TCB | 103.7 | 8.04 | 8 | 2.3 | 6.9 | 91.8 |

Figure 82:
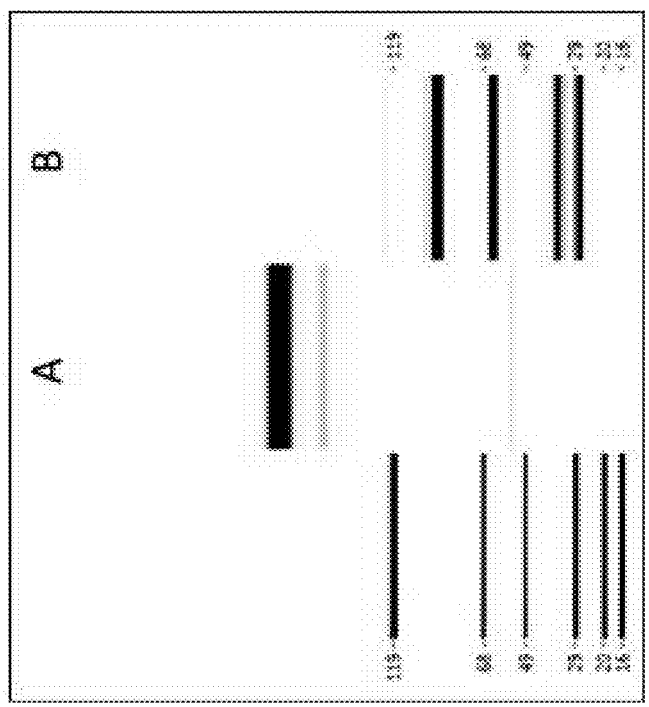
FIG. 82. CE-SDS analyses of DP47 GS TCB (2+1 Crossfab-IgG P329G LALA inverted "Untargeted TCB", SEQ ID NOs 325, 326, 327, 328) containing DP47 GS as non binding antibody and humanized CH2527 as anti CD3 antibody. Electropherogram shown as SDS-Page of DP47 GS TCB: A) non reduced, B) reduced.

FIG. 82 and Table 13 show CE-SDS analyses of DP47 GS TCB (2±1 Crossfab-IgG P329G LALA inverted) containing DP47 GS as non binding antibody and humanized CH2527 as anti CD3 antibody. (SEQ NOs: 325, 326, 327 and 328).

TABLE 13

CE-SDS analyses of DP47 GS TCB

|  | Peak | kDa | Corresponding Chain |
|---|---|---|---|
| DP47 GS TCB non reduced (A) | 1 | 165.22 | Molecule with 2 missing light chains |
|  | 2 | 181.35 | Molecule with 1 missing light chain |
|  | 3 | 190.58 | Correct molecule without N-linked glycosylation |
|  | 4 | 198.98 | Correct molecule |
| DP47 GS TCB reduced (B) | 1 | 27.86 | Light chain DP47 GS |
|  | 2 | 35.74 | Light chain huCH2527 |
|  | 3 | 63.57 | Fc(hole) |
|  | 4 | 93.02 | Fc(knob) |

Figure 83:
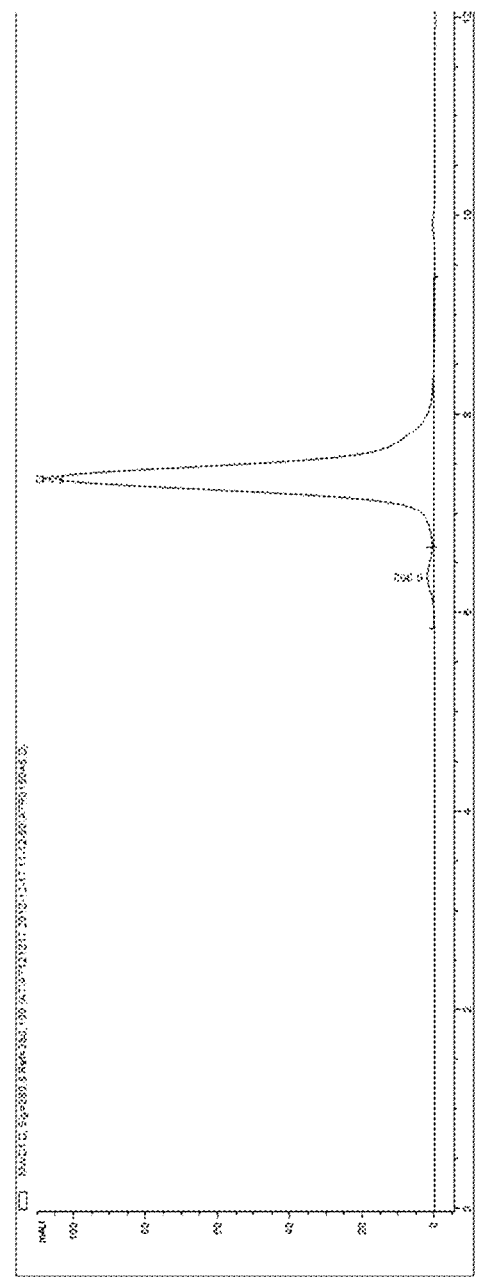
FIG. 83. Analytical size exclusion chromatography of DP47 GS TCB (2+1 Crossfab-IgG P329G LALA inverted="Untargeted TCB", SEQ ID NOs 325, 326, 327, 328) containing DP47 GS as non binding antibody and humanized CH2527 as anti CD3 antibody, Chromatogram A280 (TSKgel G3000 SW XL [Tosoh]; 25 mM K2HPO4, 125 mM NaCl, 200 mM L-Arginine Monohydrochloride, 0.02% (w/v) NaN3, pH 6.7; 20 ug sample were injected.

FIG. 83 shows analytical size exclusion chromatography of DP47 GS TCB (2+1 Crossfab-IgG P329G LALA inverted) containing DP47 GS as non binding antibody and humanized. CH2527 as anti CD3 antibody. (SEQ ID NOs: 325, 326, 327 and 328).

Example 22

Preparation of AVH TCB

The resulting variable region of heavy and light chain DNA sequences have been subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:1:1 ratio ("vector heavy chain AVH-Fc(hole)":"vector light chain antiCD3":"vector heavy chain AVH-Fab(antiCD3)-Fc(knob)").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 µg DNA. After addition of 540·1 PEI solution was vortexed for 15 s and subsequently incubated for 10 min at room temperature. Afterwards cells were mixed with the DNA/PEI solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22 µm filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 mM sodium phosphate, 20 mM sodium citrate, 0.5 M sodium chloride, pH 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding 1/10 of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GXII system (Caliper lifescience) was used according to the manufacturer's instruction. 2 ug sample was used for analyses.

The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

TABLE 14

Summary production and purification of aVH TCB

| Construct | Titer [mg/l] | Yield [mg/l] | Aggregate after 1st purification step [%] | HMW [%] | LMW [%] | Monomer [%] |
|---|---|---|---|---|---|---|
| aVH TCB | 3.8 | 0.14 | 31 | 40.6 | 5.8 | 53.6 |

Figure 85:
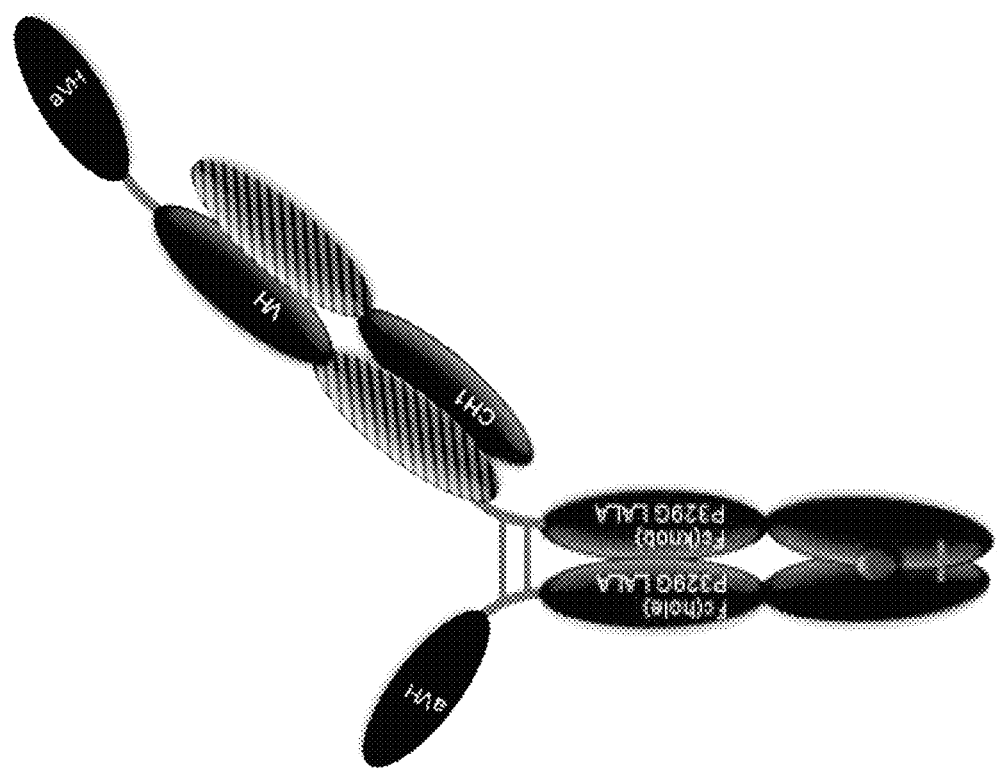
FIG. 85. Illustration of an aVH TCB molecule.

FIG. 85 shows a schematic illustration of an aVH TCB molecule.

Figure 86:
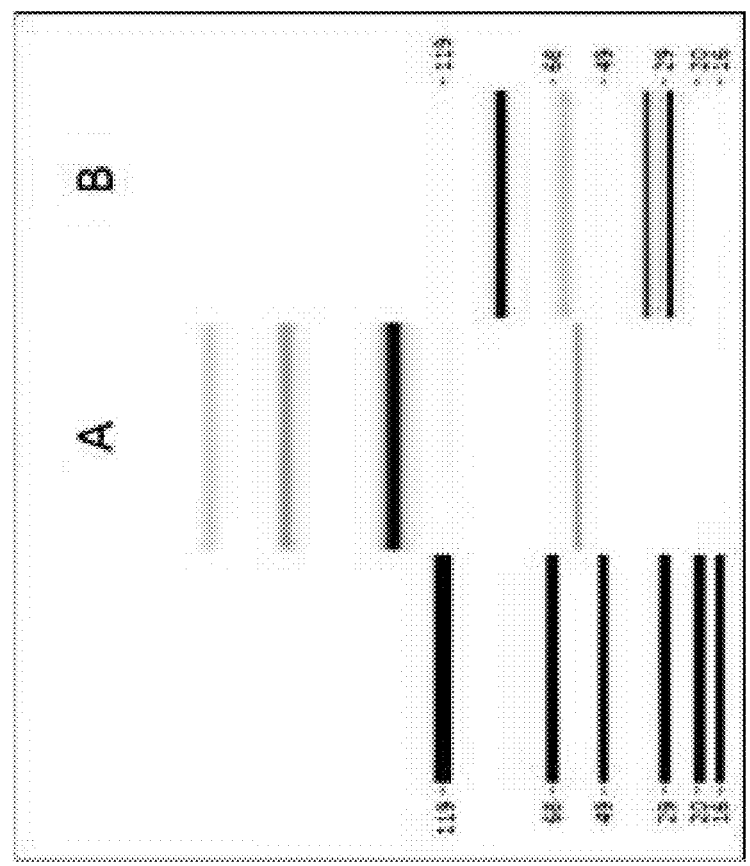
FIG. 86. CE-SDS analyses. Electropherogram shown as SDS-Page of aVH TCB (SEQ ID NOs 369, 370, 371): A) non reduced, B) reduced.

FIG. 86 and Table 15 show CE-SDS analyses of aVH TCB molecule (2±1 Crossfab-IgG P329G LALA) containing a Crossfab Fragment with a CD3 binding moiety and two aVH moieties binding MCSP (SEQ ID NOs: 369, 370 and 371).

TABLE 15

CE-SDS analyses of aVH TCB

| | Peak | kDa | Corresponding Chain |
|---|---|---|---|
| aVH TCB non reduced (A) | 1 | 58.4 | |
| | 2 | 145.6 | Correct molecule |
| | 3 | 206.19 | Fc(knob)-homodimer |
| | 4 | 249 | |
| aVH TCB reduced (B) | 1 | 27.5 | Light chain huCH2527) |
| | 2 | 34.5 | aVH-Fc(hole) |
| | 3 | 91.3 | aVH-Fab-Fc(knob) |

Example 23

Binding of aVH TCB to MCSP- and CD3-Expressing Cells

The binding of aVH TCB was tested on MCSP-expressing human melanoma cell line (MV-3) and CD3-expressing immortalized T lymphocyte line (Jurkat). Briefly, cells were harvested, counted, checked for viability and resuspended at $2 \times 10^6$ cells/ml in FACS buffer (100 µl PBS 0.1% BSA). 100 µl of cell suspension (containing $0.2 \times 10^6$ cells) were incubated in round-bottom 96-well plate for 30 min at 4° C. with increasing concentrations of the aVH TCB (2 pM-170 nM), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva). Binding curves were obtained using GraphPadPrism5 (FIG. 87 panel A, binding to MVS cells, FIG. 87 panel B, binding to Jurkat cells).

Example 24

T-Cell Killing Induced by aVH TCB Antibody

T-cell killing mediated by aVH TCB antibody assessed using MCSP-expressing human melanoma tumor cells (MV-3) and human PBMCs at 24 h and 48 h of incubation. Briefly, target cells were harvested with Trypsin/EDTA, washed, and plated at density of 25,000 cells/well using flat-bottom 96-well plates. Cells were left to adhere overnight. Peripheral blood mononuclear cells (PBMCs) were prepared by Histopaque density centrifugation of enriched lymphocyte preparations (huffy coats) obtained from healthy human donors. Fresh blood was diluted with sterile PBS and layered over Histopaque gradient (Sigma, #H8889). After centrifugation (450×g, 30 minutes, room temperature), the plasma above the PBMC-containing interphase was discarded and PBMCs transferred in a new falcon tube subsequently filled with 50 ml of PBS. The mixture was centrifuged (400×g, 10 minutes, room temperature), the supernatant discarded and the PBMC pellet washed twice with sterile PBS (centrifugation steps 350×g, 10 minutes). The resulting PBMC population was counted automatically (ViCell) and stored in RPMI1640 medium containing 10% FCS and 1% L-alanyl-L-glutamine (Biochrom, K0302) at 37° C., 5% CO2 in cell incubator until further use (no longer than 24 h). For the killing assay, the antibody was added at the indicated concentrations (range of 110 pM-80 nM in triplicates). PBMCs were added to target cells at final E:T ratio of 10:1. Target cell killing was assessed after 24 h and 48 h of incubation at 37° C., 5% CO2 by quantification of LDH released into cell supernatants by apoptotic/necrotic cells (LDH detection kit, Roche Applied Science, #644 793 001). Maximal lysis of the target cells (=100%) was achieved by incubation of target cells with 1% Triton X-100. Minimal lysis (=0%) refers to target cells co-incubated with effector cells without bi specific construct. The results show that aVH TCB induced a strong and target-specific killing of MCSP+ target cell lines, FIG. 88 panels A, B. The EC50 values related to killing assays, calculated using GraphPad-Prism5 are given in Table 16.

TABLE 16

EC50 values (pM) for T-cell mediated killing of MCSP-expressing tumor cells (MV-3) induced by aVH TCB antibody.

| Cell line | EC50 [pM] 24 h | EC50 [pM] 48 h |
|---|---|---|
| MV-3 | 9119.5 | 8967 |

BRIEF DESCRIPTION OF THE DRAWINGS

Figure 87A:
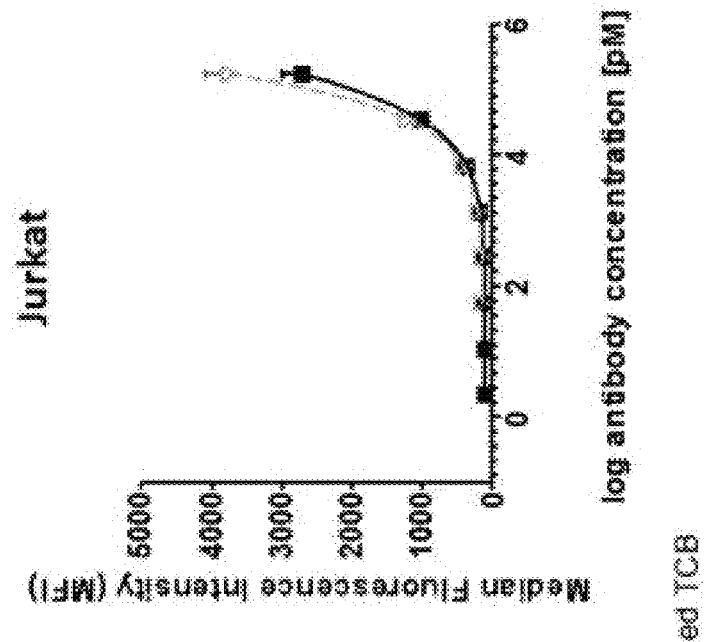
FIGS. 87A and 87B. Binding of aVH TCB (SEQ ID NOs 369, 370, 371) to MV-3 cells (MCSP+) (FIG. 87A) and Jurkat (CD3+ cells) (FIG. 87B).
Figure 87B:
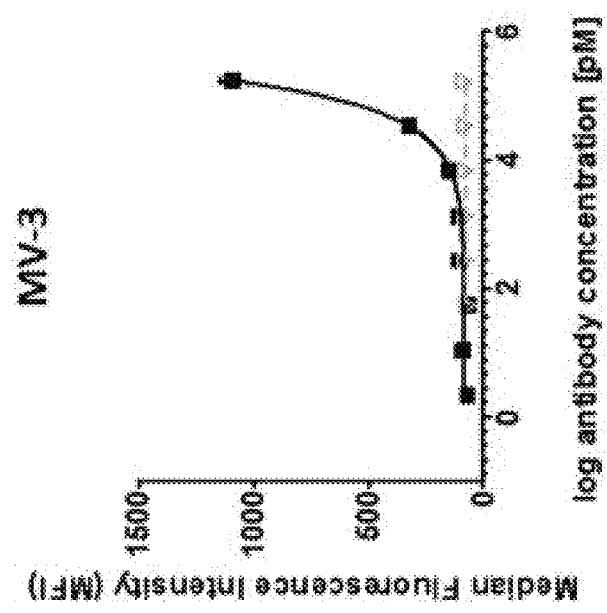

FIG. 87. Binding of aVH TCB to MV-3 cells (MCSP+) (A) and Jurkat (CD3+ cells) (B).

Figure 88B:
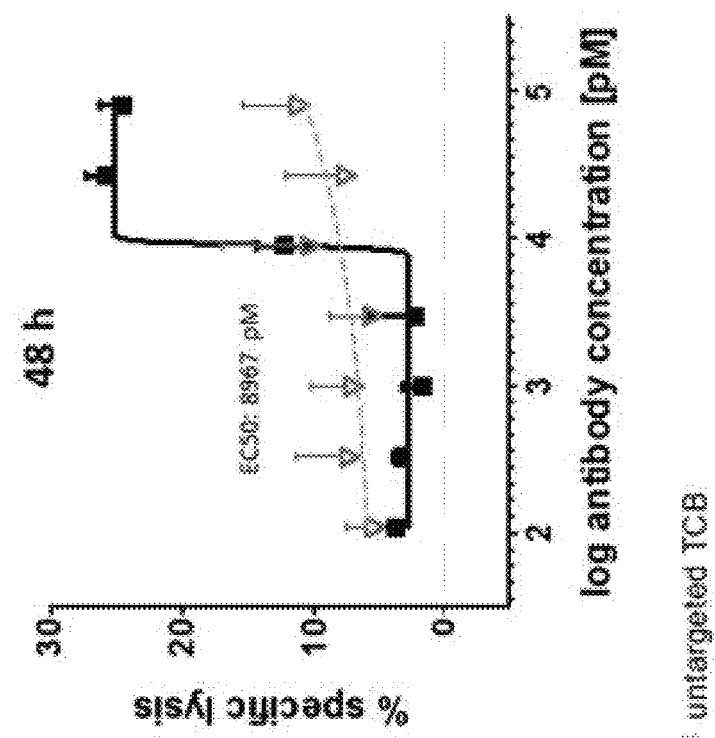
FIGS. 88A and 88B. T-cell killing induced by aVH TCB antibody (SEQ ID NOs 369, 370, 371) of MV-3 melanoma cells detected at 24 h (FIG. 88A) and 48 h (FIG. 88B) post incubation (E:T=10:1, effectors human PBMCs).
Figure 88A:
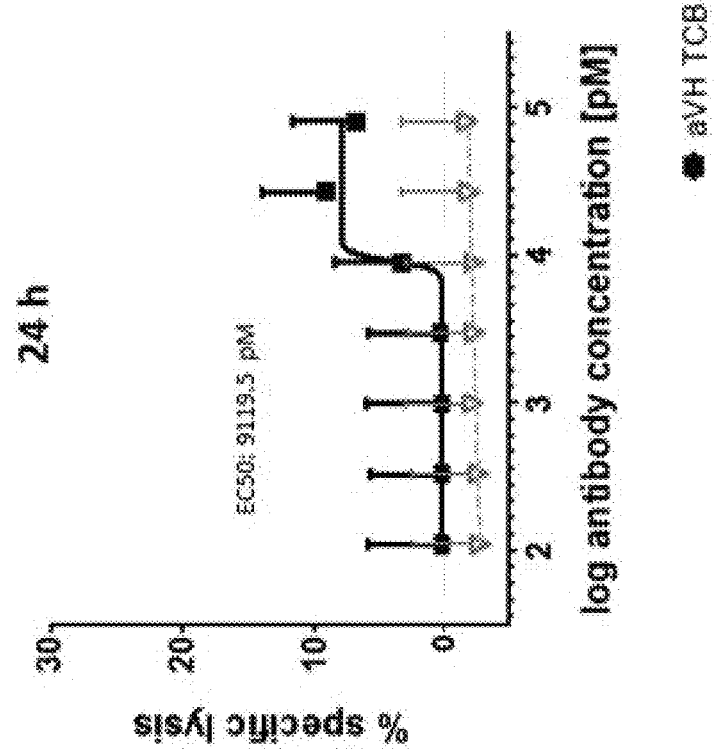

FIG. 88. T-cell killing induced by aVH TCB antibody of MV-3 melanoma cells detected at 24 h (A) and 48 h (B) post incubation (E:T=10:1, effectors human PBMCs).

Example 25

Preparation of Ankyrin Repeat Protein (DARPIN)-TCB

The resulting variable region of heavy and light chain DNA sequences have been subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:1:1 ratio ("vector heavy chain DARPIN-Fc(hole)":"vector light chain antiCD3": "vector heavy chain DARPIN-Fab(antiCD3)-Fc(knob)").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 μg DNA. After addition of 540 μl PEI solution was vortexed for 15 s and subsequently incubated for 10 min at room temperature. Afterwards cells were mixed with the DNA/PEI solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22 μm filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 mM sodium phosphate, 20 mM sodium citrate, 0.5 M sodium chloride, 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding 1/10 of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GXII system (Caliper lifescience) was used according to the manufacturer's instruction. 2 ug sample was used for analyses.

The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.2% (w/v) NaN3, pH 6.7 running buffer at 25° C.

Figure 89:
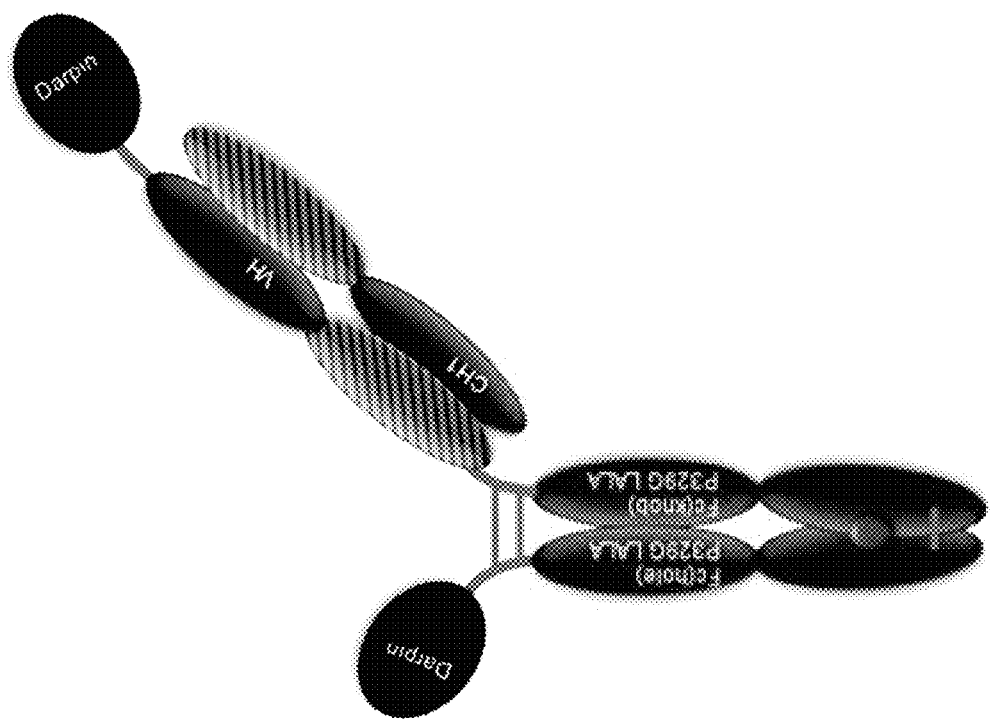
FIG. 89. Illustration of a Darpin TCB molecule.

FIG. 89 shows a schematic illustration of an Darpin-TCB molecule.

TABLE 17

Summary production and purification of DARPIN-TCB

| Construct | Titer [mg/l] | Yield [mg/l] | Aggregate after 1$^{st}$ purification step [%] | HMW [%] | LMW [%] | Monomer [%] |
|---|---|---|---|---|---|---|
| DARPIN TCB | 4.1 | 0.22 | 40 | 30.6 | 12.9 | 56.5 |

Figure 90:
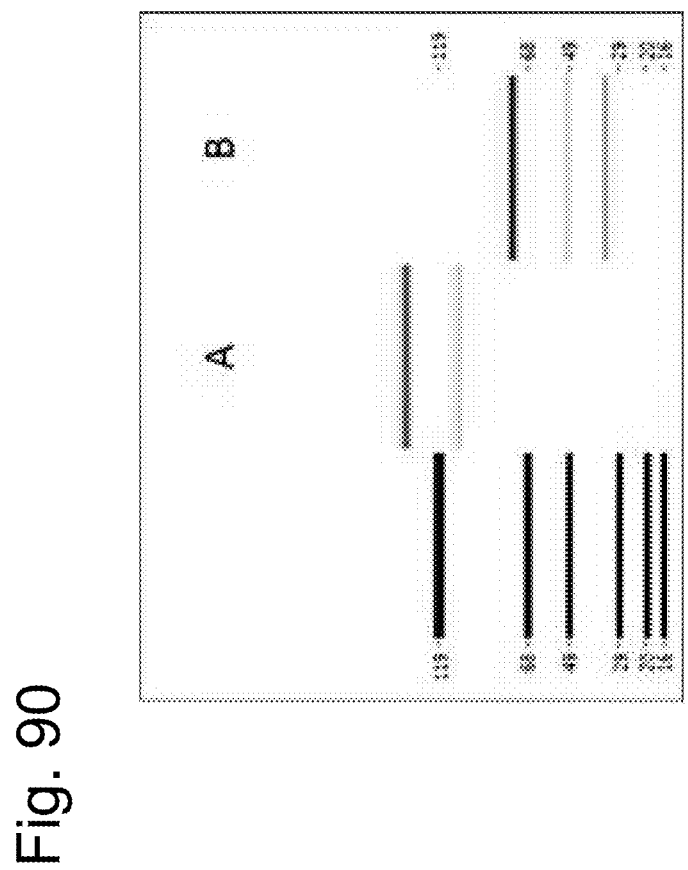
FIG. 90. CE-SDS analyses. Electropherogram shown as SDS-Page of Darpin TCB (SEQ ID NOs 376, 377, 378): A) non reduced, B) reduced.

FIG. 90 and Table 18 show CE-SDS analyses of DA PIN-TCB molecule (2+1 Crossfab-IgG P329G LALA) containing a Crossfab Fragment with a CD3 binding moiety and two Darpin moeities binding HER2 (SEQ ID NOs: 376, 377 and 378).

TABLE 18

CE-SDS analyses of Darpin TCB

| | Peak | kDa | Corresponding Chain |
|---|---|---|---|
| DARPIN TCB non reduced (A) | 1 | 107.5 | Correct molecule with missing light chain |
| | 2 | 140.38 | Correct molecule |

TABLE 18-continued

CE-SDS analyses of Darpin TCB

| | Peak | kDa | Corresponding Chain |
|---|---|---|---|
| DARPIN TCB reduced (B) | 1 | 34 | Light chain huCH2527) |
| | 2 | 49.5 | Darpin-Fc(hole) |
| | 3 | 76.6 | Darpin-Fab-Fc(knob) |

Example 26

Binding of Darpin TCB to Her2- and CD3-Expressing Cells

Figure 91B:
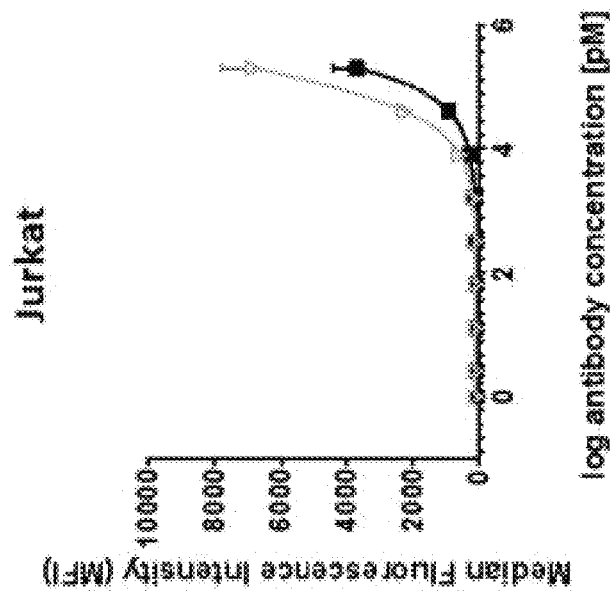
FIGS. 91A and 91B. Binding of Darpin TCB to KPL-4 cells (Her2+) (FIG. 91A) and Jurkat (CD3+ cells) (FIG. 91B).
Figure 91A:
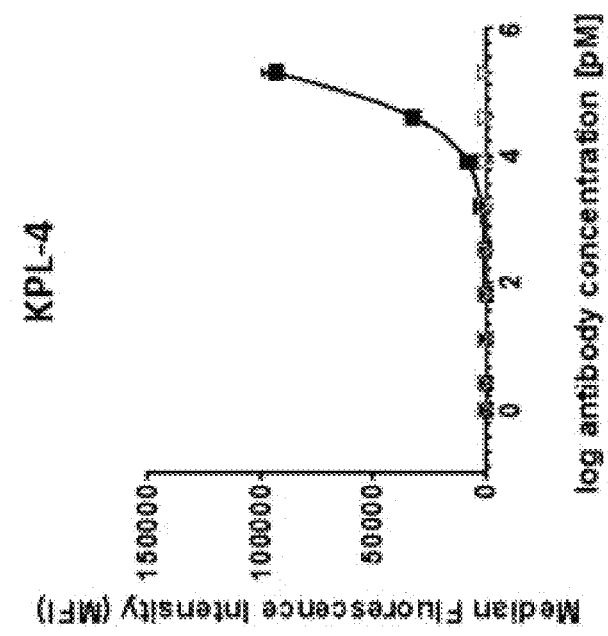

The binding of Darpin TCB was tested on Her2-expressing human melanoma cell line (KPL-4) and CD3-expressing immortalized T lymphocyte line (Jurkat). Briefly, cells were harvested, counted, checked for viability and resuspended at 2×106 cells/ml in FACS buffer (100 µl PBS 0.1% BSA). 100 µl of cell suspension (containing 0.2×106 cells) were incubated in round-bottom 96-well plate for 30 min at 4° C. with increasing concentrations of the Darpin TCB (3 pM-200 nM), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva. Binding curves were obtained using GraphPadPrism5 (FIG. 91 panel A, binding to KPL-4 cells; FIG. 91 panel B, binding to Jurkat cells).

Example 27

T-cell Killing Induced by Darpin TCB Antibody

Figure 92A:
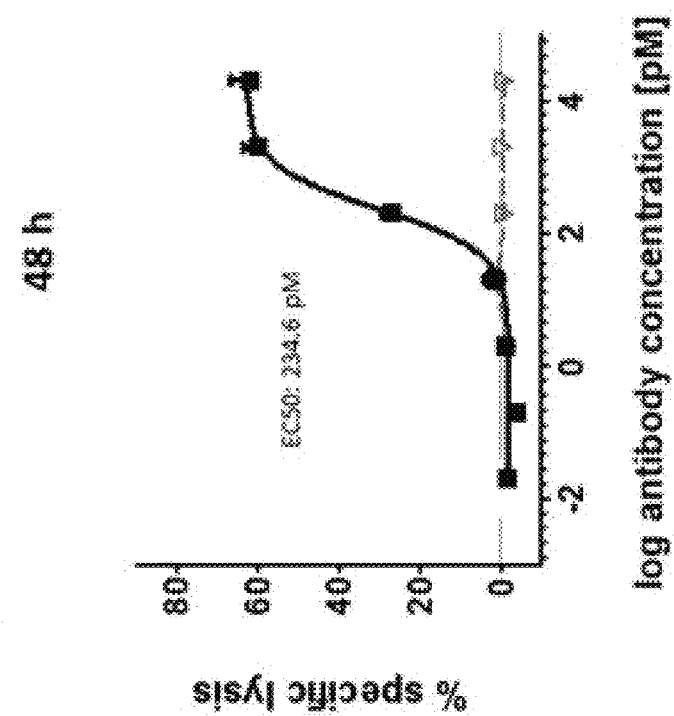
FIGS. 92A and 92B. T-cell killing induced by Darpin TCB antibody (SEQ ID NOs 376, 377, 378) of KPL-4 cells detected at 24 h (FIG. 92A) and 48 h (FIG. 92B) post incubation (E:T=10:1, effectors human PBMCs).
Figure 92B:
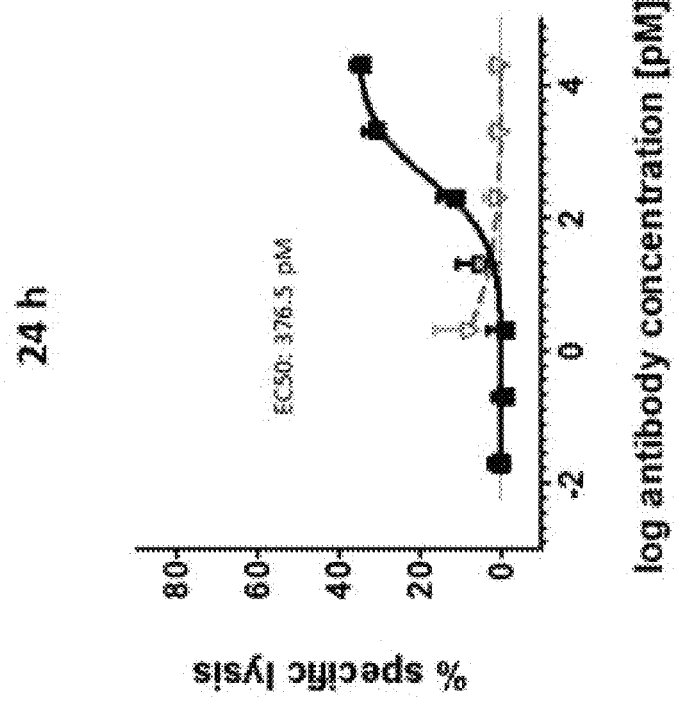

T-cell killing mediated by Darpin TCB antibody assessed using Her2-expressing human melanoma tumor cells (KPL4) and human PBMCs at 24 h and 48 h of incubation. Briefly, target cells were harvested with Trypsin/EDTA, washed, and plated at density of 25,000 cells/well using flat-bottom 96-well plates. Cells were left to adhere overnight. Peripheral blood mononuclear cells (PBMCs) were prepared by Histopaque density centrifugation of enriched lymphocyte preparations (huffy coats) obtained from healthy human donors. Fresh blood was diluted with sterile PBS and layered over Histopaque gradient (Sigma, #H8889). After centrifugation (450×g, 30 minutes, room temperature), the plasma above the PBMC-containing interphase was discarded and PBMCs transferred in a new falcon tube subsequently filled with 50 ml of PBS. The mixture was centrifuged (400×g, 10 minutes, room temperature), the supernatant discarded and the PBMC pellet washed twice with sterile PBS (centrifugation steps 350×g, 10 minutes). The resulting PBMC population was counted automatically (ViCell) and stored in RPMI1640 medium containing 10% FCS and 1% L-alanyl-L-glutamine (Biochrom, K0302) at 37° C., 5% CO2 in cell incubator until further use (no longer than 24 h). For the killing assay, the antibody was added at the indicated concentrations (range of 2 pM-20 nM in triplicates). PBMCs were added to target cells at final E:T ratio of 10:1. Target cell killing was assessed after 24 h and 48 h of incubation at 37° C., 5% $CO_2$ by quantification of LDH released into cell supernatants by apoptotic/necrotic cells (LDH detection kit, Roche Applied Science, #11 644 793 001), Maximal lysis of the target cells (=100%) was achieved by incubation of target cells with 1% Triton X-100. Minimal lysis (=0%) refers to target cells co-incubated with effector cells without bispecific construct. The results show that Darpin TCB induced a strong and target-specific killing of Her2+ target cell lines, FIG. 92 panels A, B. The EC50 values related to killing assays, calculated using GraphPad-Prism5 are given in Table 19

TABLE 19

EC50 values (pM) for T-cell mediated killing of Her2-expressing tumor cells (KPL-4) induced by Darpin TCB antibody.

| Cell line | EC50 [pM] 24 h | EC50 [pM] 48 h |
|---|---|---|
| KPL-4 | 376.5 | 234.6 |

Example 28

Preparation of hIgG1 DDKK TCB

The resulting variable region of heavy and light chain DNA sequences have been subcloned in frame with either the constant heavy chain or the constant light chain pre-inserted into the respective recipient mammalian expression vector. The antibody expression was driven by an MPSV promoter and carries a synthetic polyA signal sequence at the 3' end of the CDS. In addition each vector contains an EBV OriP sequence.

The molecule was produced by co-transfecting HEK293-EBNA cells with the mammalian expression vectors using polyethylenimine. The cells were transfected with the corresponding expression vectors in a 1:1:2:1 ratio ("vector heavy chain Fc(KK)":"vector light chain Crossfab":"vector light chain":"vector heavy chain Fc(KK) FabCrossfab").

For transfection HEK293 EBNA cells were cultivated in suspension serum free in CD CHO culture medium. For the production in 500 ml shake flask 400 million HEK293 EBNA cells were seeded 24 hours before transfection. For transfection cells were centrifuged for 5 min by 210×g, supernatant was replaced by pre-warmed 20 ml CD CHO medium. Expression vectors were mixed in 20 ml CD CHO medium to a final amount of 200 µg DNA. After addition of 540 µl PEI solution was vortexed for 15 s and subsequently incubated for 10 min at room temperature. Afterwards cells were mixed with the DNA/PEI solution, transferred to a 500 ml shake flask and incubated for 3 hours by 37° C. in an incubator with a 5% CO2 atmosphere. After incubation time 160 ml F17 medium was added and cell were cultivated for 24 hours. One day after transfection 1 mM valporic acid and 7% Feed 1 was added. After 7 days cultivation supernatant was collected for purification by centrifugation for 15 min at 210×g, the solution was sterile filtered (0.22 µm filter) and sodium azide in a final concentration of 0.01% w/v was added, and kept at 4° C.

The secreted protein was purified from cell culture supernatants by affinity chromatography using ProteinA. Supernatant was loaded on a HiTrap ProteinA HP column (CV=5 mL, GE Healthcare) equilibrated with 40 ml 20 mM sodium phosphate, 20 mM sodium citrate, 0.5 M sodium chloride, pH 7.5. Unbound protein was removed by washing with at least 10 column volume 20 mM sodium phosphate, 20 mM sodium citrate, 0.5 M sodium chloride, pH 7.5. Target protein was eluted during a gradient over 20 column volume from 20 mM sodium citrate, 0.5 M sodium chloride, pH 7.5 to 20 mM sodium citrate, 0.5 M sodium chloride, pH 2.5. Protein solution was neutralized by adding 1/10 of 0.5 M sodium phosphate, pH 8. Target protein was concentrated and filtrated prior loading on a HiLoad Superdex 200 column (GE Healthcare) equilibrated with 20 mM Histidine, 140 mM sodium chloride solution of pH 6.0.

The protein concentration of purified protein samples was determined by measuring the optical density (OD) at 280 nm, using the molar extinction coefficient calculated on the basis of the amino acid sequence.

Purity and molecular weight of molecules were analyzed by CE-SDS analyses in the presence and absence of a reducing agent. The Caliper LabChip GMT system (Caliper lifescience) was used according to the manufacturer's instruction. 2 ug sample was used for analyses.

The aggregate content of antibody samples was analyzed using a TSKgel G3000 SW XL analytical size-exclusion column (Tosoh) in 25 mM K2HPO4, 125 mM NaCl, 200 mM L-Arginine Monohydrochloride, 0.02% (w/v) NaN3, pH 6.7 running buffer at 25° C.

Human IgG1 carrying a Fc with DDKK mutation can be used to generate heterodimeric T cell bispecific molecules. After the first purification step main protein population were homo dimeric molecules containing Fc(KK). This LMW impurity can be removed mainly by size exclusion chromatography and the correct heterodimer can be enriched.

TABLE 20

Summary production and purification of hIgG1 DDKK TCB

| Construct | Titer [mg/l] | Yield [mg/l] | Aggregate after 1st purification step [%] | LMW after 1st purification step [%] | HMW [%] | LMW [%] | Monomer [%] |
|---|---|---|---|---|---|---|---|
| hIgG1 DDKK TCB | 3.5 | 0.47 | 1.5 | 80.7 | 14.3 | 22.8 | 62.9 |

Figure 93:
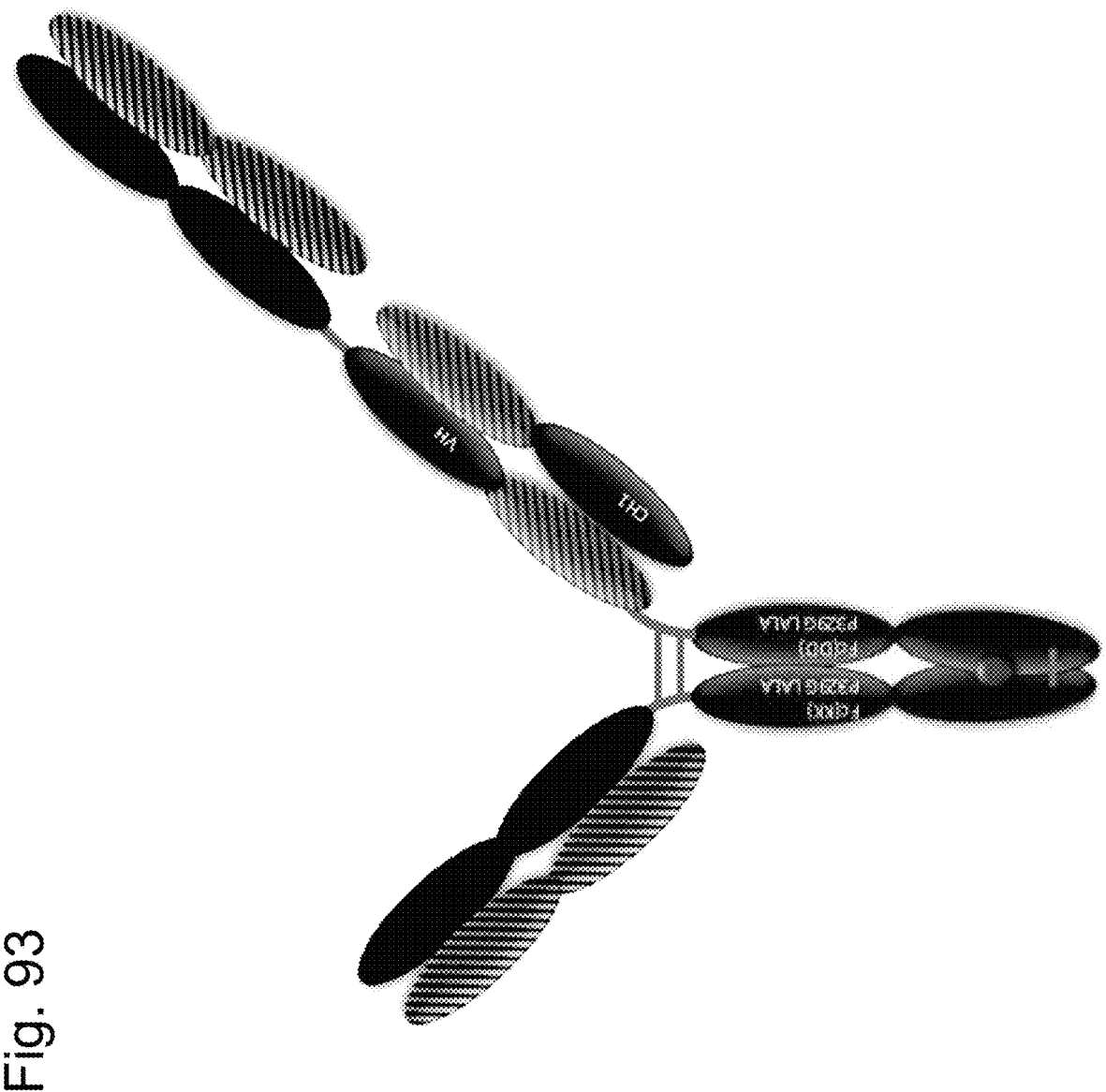
FIG. 93. Illustration of a hIgG1 DDKK TCB molecule.

FIG. 93 shows a schematic illustration of hIgG1 DDKK-TCB molecule.

Figure 94:
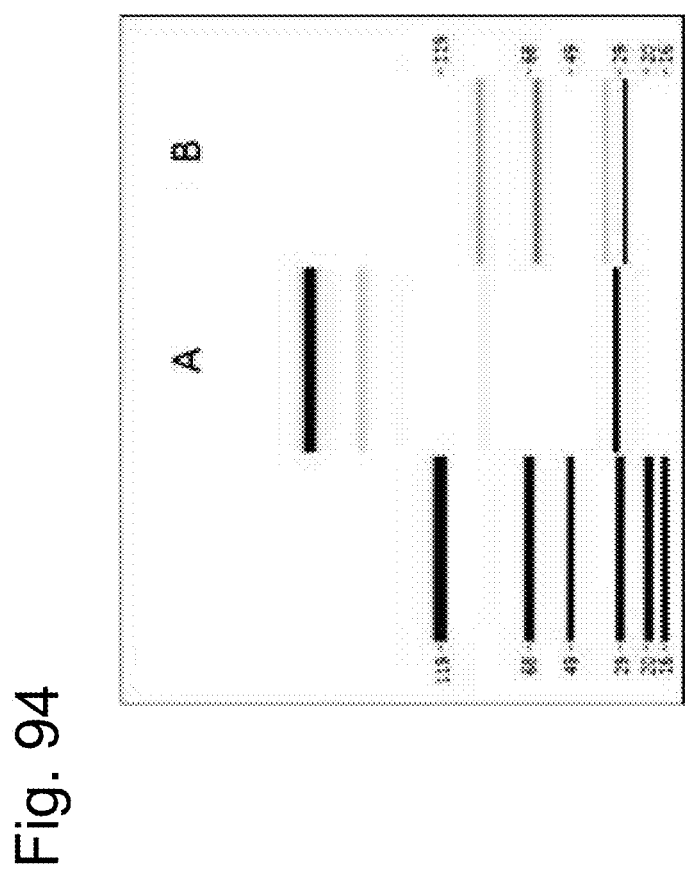
FIG. 94. CE-SDS analyses. Electropherogram shown as SDS-Page of hIgG1 DDKK TCB (SEQ NOs 372, 373, 374, 375): A) non reduced, B) reduced.

FIG. 94 and Table 21 show CE-SDS analyses of hIgG1 DDKK-TCB molecule (2+1 Crossfab-IgG P329G LALA) containing a Crossfab Fragment with a CD3 binding moiety and two MCSP binding moeities (SEQ ID NOs: 372, 373, 374 and 375).

TABLE 21

CE-SDS analyses of hIgG1 DDKK TCB

| | Peak | kDa | Corresponding Chain |
|---|---|---|---|
| hIgG1 DDKK TCB non reduced (A) | 1 | 30.2 | Unbound Light chain |
| | 2 | 170.4 | FC(KK) homo dimer |
| | 3 | 207.9 | Correct molecule |
| hIgG1 DDKK TCB reduced (B) | 1 | 27.4 | Light chain ML2(G3) |
| | 2 | 34.33 | Light Chain huCH2527 |
| | 3 | 64.7 | Fab-Fc(KK) |
| | 4 | 96.1 | Fab-Crossfab-Fc(DD) |

Example 29

Binding of hIgG1 DDKK TCB to MCSP- and CD3-Expressing Cells

The binding of hIgG1 DDKK TCB was tested on MCSP-expressing human melanoma cell line (MV-3) and CD3-expressing immortalized T lymphocyte line (Jurkat). Briefly, cells were harvested, counted, checked for viability and resuspended at 2×106 cells/ml in FACS buffer (100 µl PBS 0.1% BSA). 100 µl of cell suspension (containing 0.2×106 cells) were incubated in round-bottom 96-well plate for 30 min at 4° C. with increasing concentrations of the hIgG1. DDKK TCB (2 pM-170 nM), washed twice with cold PBS 0.1% BSA, re-incubated for further 30 min at 4° C. with the PE-conjugated AffiniPure F(ab')2 Fragment goat anti-human IgG Fcg Fragment Specific secondary antibody (Jackson Immuno Research Lab PE #109-116-170), washed twice with cold PBS 0.1% BSA and immediately analyzed by FACS using a FACS CantoII (Software FACS Diva). Binding curves were obtained using GraphPadPrism5 (FIG. 95 panel A, binding to MV-3 cells, EC50=12803 pM; FIG. 95 panel B, binding to Jurkat cells).

Example 30

T-Cell Killing Induced by hIgG1 DDKK TCB Antibody

Figure 96B:
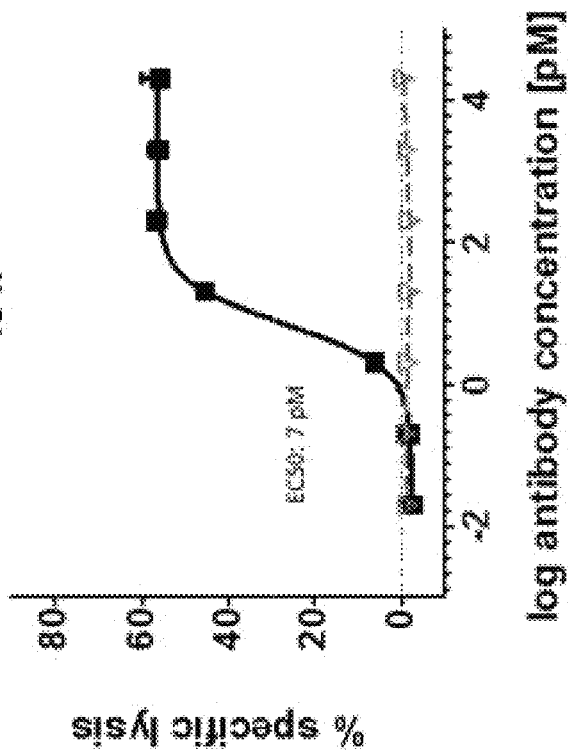
FIGS. 96A and 96B. T-cell killing induced by hIgG1 DDKK TCB antibody (SEQ ID NOs 372, 373, 374, 375) of MV-3 (medium MCSP) detected at 24 h (FIG. 96A) and 48 h (FIG. 96B) post incubation (E:T=10:1, effectors human PBMCs).
Figure 96A:
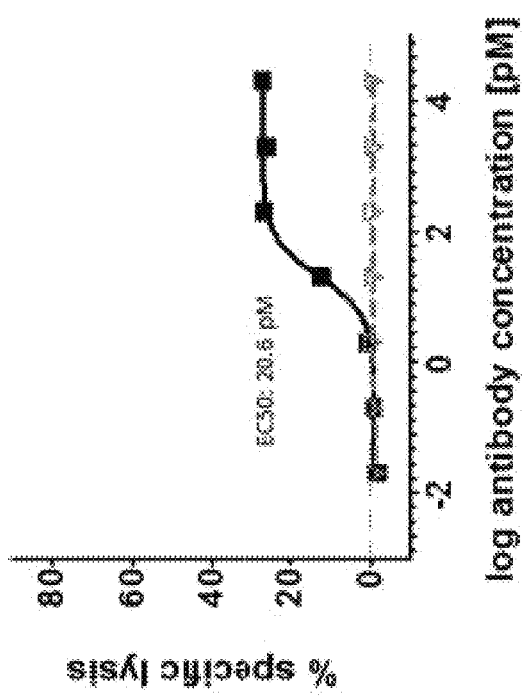

T-cell killing mediated by hIgG1 DDKK TCB antibody was assessed using MCSP-expressing human melanoma tumor cells (MV-3) and human PBMCs at 24 h and 48 h of incubation. Briefly, target cells were harvested with Trypsin/EDTA, washed, and plated at density of 25,000 cells/well using flat-bottom 96-well plates. Cells were left to adhere overnight. Peripheral blood mononuclear cells (PBMCs) were prepared by Histopaque density centrifugation of enriched lymphocyte preparations (buffy coats) obtained from healthy human donors. Fresh blood was diluted with sterile PBS and layered over Histopaque gradient (Sigma, #H8889). After centrifugation (450×g, 30 minutes, room temperature), the plasma above the PBMC-containing interphase was discarded and PBMCs transferred in a new falcon tube subsequently filled with 50 ml of PBS. The mixture was centrifuged (400×g, 10 minutes, room temperature), the supernatant discarded and the PBMC pellet washed twice with sterile PBS (centrifugation steps 350×g, 10 minutes). The resulting PBMC population was counted automatically (ViCell) and stored in RPMI1640 medium containing 10% FCS and 1% L-alanyl-L-glutamine (Biochrom, K0302) at 37° C., 5% CO2 in cell incubator until further use (no longer than 24 h). For the killing assay, the antibody was added at the indicated concentrations (range of 0.02 pM-20 nM in triplicates). PBMCs were added to target cells at final E:T ratio of 10:1. Target cell killing was assessed after 24 h and 48 h of incubation at 37° C., 5% $CO_2$ by quantification of LDH released into cell supernatants by apoptotic/necrotic cells (LDH detection kit, Roche Applied Science, #11 644 793 001). Maximal lysis of the target cells (=100%) was achieved by incubation of target cells with 1% Triton X-100. Minimal lysis (=0%) refers to target cells co-incubated with effector cells without bispecific construct. The results show that hIgG1 DDKK TCB induced a strong and target-specific killing of MCSP-F target cell lines, FIG. 96 panels A, B. The EC50 values related to killing assays, calculated using GraphPadPrism5 are given in Table 22.

TABLE 22

EC50 values (pM) for T-cell mediated killing of MCSP-expressing tumor cells (MV-3) induced by hIgG1 DDKK TCB antibody.

| Cell line | EC50 [pM] 24 h | EC50 [pM] 48 h |
|---|---|---|
| MV-3 | 20.6 | 7 |

SEQ ID NOs 1-266 provided in the attached Sequence Listing.

| | Protein sequences | | |
|---|---|---|---|
| | | CD3 $_{CH2527}$ | SEQ ID NO. |
| Heavy chain "CD3 $_{CH2527\ (VH\_3\text{-}23(12))}$" | | EVQLLESGGGLVQPGGSLRLSCAASGFTFS TYAMNWVRQAPGKGLEWVSRIRSKYNNY ATYYADSVKGRFTISRDDSKNTLYLQMNS LRAEDTAVYYCVRHGNFGNSYVSWFAYW GQGTLVTVSSASTKGPSVFPLAPSSKSTSGG TAALGCLVKDYFPEPVTVSWNSGALTSGV HTFPAVLQSSGLYSLSSVVTVPSSSLGTQTY ICNVNHKPSNTKVDKKVEPKSCDKTHTCPP CPAPELLGGPSVFLFPPKPKDTLMISRTPEV TCVVVDVSHEDPEVKFNWYVDGVEVHNA KTKPREEQYNSTYRVVSVLTVLHQDWLNG KEYKCKVSNKALPAPIEKTISKAKGQPREP QVYTLPPSRDELTKNQVSLTCLVKGFYPSD IAVEWESNGQPENNYKTTPPVLDSDGSFFL YSKLTVDKSRWQQGNVFSCSVMHEALHN HYTQKSLSLSPGK | 267 |
| Light chain "CD3 $_{CH2527\ (VH\_7\text{-}46(13))}$" | | QAVVTQEPSLTVSPGGTVTLTCGSSTGAVT TSNYANWVQEKPGQAFRGLIGGTNKRAPG TPARFSGSLLGGKAALTLSGAQPEDEAEYY CALWYSNLWVFGGGTKLTVLGQPKAAPS VTLFPPSSEELQANKATLVCLISDFYPGAVT VAWKADSSPVKAGVETTTPSKQSNNKYAA SSYLSLTPEQWKSHRSYSCQVTHEGSTVEK TVAPTECS | 268 |
| VH "CD3 $_{CH2527\ (VH\_3\text{-}23(12))}$" | | EVQLLESGGGLVQPGGSLRLSCAASGFTFS TYAMNWVRQAPGKGLEWVSRIRSKYNNY ATYYADSVKGRFTISRDDSKNTLYLQMNS LRAEDTAVYYCVRHGNFGNSYVSWFAYW GQGTLVTVSS | 269 |
| VH CDR H1 "CD3 $_{CH2527\ (VH\_3\text{-}23(12))}$" | | TYAMN | 270 |
| VH CDR H2 "CD3 $_{CH2527\ (VH\_3\text{-}23(12))}$" | | RIRSKYNNYATYYADSVKG | 271 |
| VH CDR H3 "CD3 $_{CH2527\ (VH\_3\text{-}23(12))}$" | | HGNFGNSYVSWFAY | 272 |
| VL "CD3 $_{CH2527\ (VL\_7\text{-}46(13))}$" | | QAVVTQEPSLTVSPGGTVTLTCGSSTGAVT TSNYANWVQEKPGQAFRGLIGGTNKRAPG TPARFSGSLLGGKAALTLSGAQPEDEAEYY CALWYSNLWVFGGGTKLTVL | 273 |
| VL CDR L1 "CD3 $_{CH2527\ (VL\_7\text{-}46(13))}$" | | GSSTGAVTTSNYAN | 374 |
| VL CDR L2 "CD3 $_{CH2527\ (VL\_7\text{-}46(13))}$" | | GTNKRAP | 375 |
| VL CDR L3 "CD3 $_{CH2527\ (VL\_7\text{-}46(13))}$" | | ALWYSNLWV | 376 |

-continued

Protein sequences

MCSP M4-3(C1) ML2(G3)

| | | SEQ ID NO |
|---|---|---|
| Heavy chain "MCSP M4-3(C1)" | QVQLQESGPGLVKPSQTLSLTCTVSGGSITS GYYWNWIRQHPGKGLEWIGYITFDGSNNY NPSLKSRVTISRDTSKNQFSLKLSSVTAADT AVYYCADFDYWGQGTLVTVSSASTKGPSV FPLAPSSKSTSGGTAALGCLVKDYFPEPVT VSWNSGALTSGVHTFPAVLQSSGLYSLSSV VTVPSSSLGTQTYICNVNHKPSNTKVDKKV EPKSCDKTHTCPPCPAPELLGGPSVFLFPPK PKDTLMISRTPEVTCVVVDVSHEDPEVKFN WYVDGVEVHNAKTKPREEQYNSTYRVVS VLTVLHQDWLNGKEYKCKVSNKALPAPIE KTISKAKGQPREPQVYTLPPSRDELTKNQV SLTCLVKGFYPSDIAVEWESNGQPENNYKT TPPVLDSDGSFFLYSKLTVDKSRWQQGNV FSCSVMHEALHNHYTQKSLSLSPGK | 277 |
| Light chain "MCSP ML2(G3)" | DIQMTQSPSSLSASVGDRVTITCRASQGIRN YLNWYQQKPGKAPKLLIYYTSSLHSGVPSR FSGSGSGTDYTLTISSLQPEDFATYYCQQYS ALPWTFGQGTKVEIKRTVAAPSVFIFPPSDE QLKSGTASVVCLLNNFYPREAKVQWKVD NALQSGNSQESVTEQDSKDSTYSLSSTLTL SKADYEKHKVYACEVTHQGLSSPVTKSFN RGEC | 278 |
| VH "MCSP M4-3(C1)" | QVQLQESGPGLVKPSQTLSLTCTVSGGSITS GYYWNWIRQHPGKGLEWIGYITFDGSNNY NPSLKSRVTISRDTSKNQFSLKLSSVTAADT AVYYCADFDYWGQGTLVTVSS | 279 |
| VH CDR H1 "MCSP M4-3(C1)" | SGYYWN | 280 |
| VH CDR H2 "MCSP M4-3(C1)" | YITFDGSNNYNPSLKS | 281 |
| VH CDR H3 "MCSP M4-3(C1)" | FDY | 282 |
| VL "MCSP ML2(G3)" | DIQMTQSPSSLSASVGDRVTITCRASQGIRN YLNWYQQKPGKAPKLLIYYTSSLHSGVPSR FSGSGSGTDYTLTISSLQPEDFATYYCQQYS ALPWTFGQGTKVEIK | 283 |
| VL CDR L1 "MCSP ML2(G3)" | RASQGIRNYLN | 284 |
| VL CDR L2 "MCSP ML2(G3)" | YTSSLHS | 285 |
| VL CDR L3 "MCSP ML2(G3)" | QQYSALPWT | 286 |

CEA CH1A1A 98-99 2F1

| | | SEQ ID NO |
|---|---|---|
| Heavy chain "CEA CH1A1A 98-99" | QVQLVQSGAEVKKPGASVKVSCKASGYTF TEFGMNWVRQAPGQGLEWMGWINTKTGE ATYVEEFKGRVTFTTDTSTSTAYMELRSLR SDDTAVYYCARWDFAYYVEAMDYWGQG TTVTVSSASTKGPSVFPLAPSSKSTSGGTAA LGCLVKDYFPEPVTVSWNSGALTSGVHTFP AVLQSSGLYSLSSVVTVPSSSLGTQTYICNV NHKPSNTKVDKKVEPKSCDKTHTCPPCPAP ELLGGPSVFLFPPKPKDTLMISRTPEVTCVV VDVSHEDPEVKFNWYVDGVEVHNAKTKP REEQYNSTYRVVSVLTVLHQDWLNGKEY KCKVSNKALPAPIEKTISKAKGQPREPQVY TLPPSRDELTKNQVSLTCLVKGFYPSDIAVE WESNGQPENNYKTTPPVLDSDGSFFLYSKL TVDKSRWQQGNVFSCSVMHEALHNHYTQ KSLSLSPGK | 287 |

-continued

| Protein sequences | | |
|---|---|---|
| Light chain ,,CEA $_{2F1}$" | DIQMTQSPSSLSASVGDRVTITCKASAAVG TYVAWYQQKPGKAPKLLIYSASYRKRGVP SRFSGSGSGTDFTLTISSLQPEDFATYYCHQ YYTYPLFTFGQGTKLEIKRTVAAPSVFIFPP SDEQLKSGTASVVCLLNNFYPREAKVQWK VDNALQSGNSQESVTEQDSKDSTYSLSSTL TLSKADYEKHKVYACEVTHQGLSSPVTKS FNRGEC | 288 |
| VH ,,CEA $_{CH1A1A\ 98\text{-}99}$" | QVQLVQSGAEVKKPGASVKVSCKASGYTF TEFGMNWVRQAPGQGLEWMGWINTKTGE ATYVEEFKGRVTFTTDTSTSTAYMELRSLR SDDTAVYYCARWDFAYYVEAMDYWGQG TTVTVSS | 289 |
| VH CDR H1 ,,CEA $_{CH1A1A\ 98\text{-}99}$" | EFGMN | 290 |
| VH CDR H2 ,,CEA $_{CH1A1A\ 98\text{-}99}$" | WINTKTGEATYVEEFKG | 291 |
| VH CDR H3 ,,CEA $_{CH1A1A\ 98\text{-}99}$" | WDFAYYVEAMDY | 292 |
| VL ,,CEA $_{2F1}$" | DIQMTQSPSSLSASVGDRVTITCKASAAVG TYVAWYQQKPGKAPKLLIYSASYRKRGVP SRFSGSGSGTDFTLTISSLQPEDFATYYCHQ YYTYPLFTFGQGTKLEIK | 293 |
| VL CDR L1 ,,CEA $_{2F1}$" | KASAAVGTYVA | 294 |
| VL CDR L2 ,,CEA $_{2F1}$" | SASYRKR | 295 |
| VL CDR L3 ,,CEA $_{2F1}$" | HQYYTYPLFT | 296 |
| CD3 $_{VL\_7\text{-}43(11)/VH\_3\text{-}23(12)}$ | | SEQ ID NO. |
| VH "CD3 $_{CH2527\ (VH\_3\text{-}23(12))}$" | EVQLLESGGGLVQPGGSLRLSCAASGFTFSTY AMNWVRQAPGKGLEWVSRIRSKYNNYATYY ADSVKGRFTISRDDSKNTLYLQMNSLRAEDTA VYYCVRHGNFGNSYVSWFAYWGQGTLVTVS S | 269 |
| VH CDR H1 "CD3 $_{CH2527\ (VH\_3\text{-}23(12))}$" | TYAMN | 270 |
| VH CDR H2 "CD3 $_{CH2527\ (VH\_3\text{-}23(12))}$" | RIRSKYNNYATYYADSVKG | 271 |
| VH CDR H3 "CD3 $_{CH2527\ (VH\_3\text{-}23(12))}$" | HGNFGNSYVSWFAY | 272 |
| VL "CD3 $_{CH2527\ (VL\_7\text{-}43(11))}$" | QTVVTQEPSLTVSPGGTVTLTCGSSTGAVTTS NYANWVQQKPGQAPRGLIGGTNKRAPGTPAR FSGSLLGGKAALTLSGVQPEDEAEYYCALWY SNLWVFGGGTKLTVLSS | 297 |
| VL CDR L1 "CD3 $_{CH2527\ (VL\_7\text{-}43(11))}$" | GSSTGAVTTSNYAN | 274 |
| VL CDR L2 "CD3 $_{CH2527\ (VL\_7\text{-}43(11))}$" | GTNKRAP | 275 |
| VL CDR L3 "CD3 $_{CH2527\ (VL\_7\text{-}43(11))}$" | ALWYSNLWV | 276 |
| CD3 $_{VL\_7\text{-}43(11)/VHcomboA49SV93A}$ | | |
| ,,CD3 $_{CH2527\ (VHcomboA49SV93A)}$" | EVQLLESGGGLVQPGGSLRLSCAASGFTFSTY AMNWVRQAPGKGLEWVSRIRSKYNNYATYY ADSVKGRFTISRDDSKNTLYLQMNSLRAEDTA VYYCARHGNFGNSYVSWFAYWGQGTLVTVS S | 298 |

| Protein sequences | | |
|---|---|---|
| VH CDR H1 "CD3 $_{CH2527}$ (VHcomboA49SV93A)" | TYAMN | 270 |
| VH CDR H2 "CD3 $_{CH2527}$ (VHcomboA49SV93A)" | RIRSKYNNYATYYADSVKG | 271 |
| VH CDR H3 "CD3 $_{CH2527}$ (VHcomboA49SV93A)" | HGNFGNSYVSWFAY | 272 |
| VL "CD3 $_{CH2527}$ (VL_7-43(11))" | QTVVTQEPSLTVSPGGTVTLTCGSSTGAVTTS NYANWVQQKPGQAPRGLIGGTNKRAPGTPAR FSGSLLGGKAALTLSGVQPEDEAEYYCALWY SNLWVFGGGTKLTVLSS | 297 |
| VL CDR L1 "CD3 $_{CH2527}$ (VL_7-43(11))" | GSSTGAVTTSNYAN | 274 |
| VL CDR L2 "CD3 $_{CH2527}$ (VL_7-43(11))" | GTNKRAP | 275 |
| VL CDR L3 "CD3 $_{CH2527}$ (VL_7-43(11))" | ALWYSNLWV | 276 |
| CD3 $_{VL\_7-46(13)/VHcomboA49SV93A}$ | | |
| VH "CD3 $_{CH2527}$ (VHcomboA49SV93A)" | EVQLLESGGGLVQPGGSLRLSCAASGFTFSTY AMNWVRQAPGKGLEWVSRTRSKYNNYATYY ADSVKGRFTISRDDSKNTLYLQMNSLRAEDTA VYYCARHGNFGNSYVSWFAYWGQGTLVTVS S | 298 |
| VH CDR H1 "CD3 $_{CH2527}$ (VHcomboA49SV93A)" | TYAYIN | 270 |
| VH CDR H2 "CD3 $_{CH2527}$ (VHcomboA49SV93A)" | RIRSKYNNYATYYADSVKG | 271 |
| VH CDR H3 "CD3 $_{CH2527}$ (VHcomboA49SV93A)" | HGNFGNSYVSWFAY | 272 |
| VL "CD3 $_{CH2527}$ (VL_7-46(13))" | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVL | 273 |
| VL CDR L1 "CD3 $_{CH2527}$ (VL_7-46(13))" | GSSTGAVTTSNYAN | 274 |
| VL CDR L2 "CD3 $_{CH2527}$ (VL_7-46(13))" | GTNKRAP | 275 |
| VL CDR L3 "CD3 $_{CH2527}$ (VL_7-46(13))" | ALWYSNLWV | 276 |
| CD3 $_{VL\_7-43(11)/VHcomboA49SV93AR94K}$ | | |
| VH "CD3 $_{CH2527}$ (VHcomboA49SV93AR94K)" | EVQLLESGGGLVQPGGSLRLSCAASGFTFSTY AMNWVRQAPGKGLEWVSRIRSKYNNYATYY ADSVKGRFTISRDDSKNTLYLQMNSLRAEDTA VYYCAKHGNFGNSYVSWFAYWGQGTLVTVS S | 299 |
| VH CDR H1 "CD3 $_{CH2527}$ (VHcomboA49SV93AR94K)" | TYAMN | 270 |
| VH CDR H2 "CD3 $_{CH2527}$ (VHcomboA49SV93AR94K)" | RIRSKYNNYATYYADSVKG | 271 |

| Protein sequences | | |
|---|---|---|
| VH CDR H3<br>,,CD3 _CH2527_<br>_(VHcomboA49SV93AR94K)_ " | HGNFGNSYVSWFAY | 272 |
| VL<br>"CD3 _CH2527_ _(VL_7-43(11))_ " | QTVVTQEPSLTVSPGGTVTLTCGSSTGAVTTS<br>NYANWVQQKPGQAPRGLIGGTNKRAPGTPAR<br>FSGSLLGGKAALTLSGVQPEDEAEYYCALWY<br>SNLWVFGGGTKLTVLSS | 297 |
| VL CDR L1<br>"CD3 _CH2527_ _(VL_7-43(11))_ " | GSSTGAVTTSNYAN | 274 |
| VL CDR L2<br>"CD3 _CH2527_ _(VL_7-43(11))_ " | GTNKRAP | 275 |
| VL CDR L3<br>"CD3 _CH2527_ _(VL_7-43(11))_ " | ALWYSNLWV | 276 |
| CD3 _VL_7-46(13) / VHcomboA49SV93AR94K_ | | |
| VH<br>,,CD3 _CH2527_<br>_(VHcomboA49SV93AR94K)_ " | EVQLLESGGGLVQPGGSLRLSCAASGFTFSTY<br>AMNWVRQAPGKGLEWVSRIRSKYNNYATYY<br>ADSVKGRFTISRDDSKNTLYLQMNSLRAEDTA<br>VYYCAKHGNFGNSYVSWFAYWGQGTLVTVS<br>S | 299 |
| VH CDR H1<br>,,CD3 _CH2527_<br>_(VHcomboA49SV93AR94K)_ " | TYAMN | 270 |
| VH CDR H2<br>,,CD3 _CH2527_<br>_(VHcomboA49SV93AR94K)_ " | RIRSKYNNYATYYADSVKG | 271 |
| VH CDR H3<br>,,CD3 _CH2527_<br>_(VHcomboA49SV93AR94K)_ " | HGNFGNSYVSWFAY | 272 |
| VL<br>"CD3 _CH2527_ _(VL_7-46(13))_ " | QAVVTQEPSLTVSPGGTVTLTCGSSTGAVTTS<br>NYANWVQEKPGQAFRGLIGGTNKRAPGTPAR<br>FSGSLLGGKAALTLSGAQPEDEAEYYCALWY<br>SNLWVFGGGTKLTVL | 273 |
| VL CDR L1<br>"CD3 _CH2527_ _(VL_7-46(13))_ " | GSSTGAVTTSNYAN | 274 |
| VL CDR L2<br>"CD3 _CH2527_ _(VL_7-46(13))_ " | GTNKRAP | 275 |
| VL CDR L3<br>"CD3 _CH2527_ _(VL_7-46(13))_ " | ALWYSNLWV | 276 |
| MCSP | | SEQ ID NO |
| VH<br>,,MCSP _M4-3(D6)_ " | QVQLQESGPGLVKPSQTLSLTCTVSGGSITS<br>GYYWNWIRQHPGKGLEWIGYITFDGKNNY<br>NPSLKSRVTISRDTSKNQFSLKLSSVTAADT<br>AVYYCADFDYWGQGTLVTVSS | 300 |
| VH CDR H1<br>,,MCSP _M4-3(D6)_ " | SGYYWN | 280 |
| VH CDR H2<br>,,MCSP _M4-3(D6)_ " | ITFDGKNNYNPSLKS | 301 |
| VH CDR H3<br>,,MCSP _M4-3(D6)_ " | FDY | 282 |
| VH<br>,,MCSP _M4-3(A7)_ " | QVQLQESGPGKVKPSQTLSLTCTVSGGSIT<br>DGYYWNWIRQHPGKGLEWIGYITFDGRNN<br>YNPSLKSRVTISRDTSKNQFSLKLSSVTAAD<br>TAVYYCADFDYWGQGTLVTVSS | 302 |
| VH CDR H1<br>,,MCSP _M4-3(A7)_ " | DGYYWN | 303 |

| Protein sequences | | |
|---|---|---|
| VH CDR H2 "MCSP M4-3(A7)" | ITFDGRNNYNPSLKS | 304 |
| VH CDR H3 "MCSP M4-3(A7)" | FDY | 282 |
| VH "MCSP M4-3(B7)" | QVQLQESGPGLVKPSQTLSLTCTVSGGSITS GYYWNWIRQHPGKGLEWIGYITFDGINNY NPSLKSRVTISRDTSKNQFSLKLSSVTAADT AVYYCADFDYWGQGTLVTVSS | 305 |
| VH CDR H1 "MCSP M4-3(B7)" | SGYYWN | 280 |
| VH CDR H2 "MCSP M4-3(B7)" | ITFDGINNYNPSLKS | 306 |
| VH CDR H3 "MCSP M4-3(B7)" | FDY | 282 |
| VH "MCSP M4-3(B8)" | QVQLQESGPGLVKPSQTLSLTCTVSGGSITS GYYWNWIRQHPGKGLEWIGYITFDGRNNY NPSLKSRVTISRDTSKNQFSLKLSSVTAADT AVYYCADFDYWGQGTLVTVSS | 307 |
| VH CDR H1 "MCSP M4-3(B8)" | SGYYWN | 280 |
| VH CDR H2 "MCSP M4-3(B8)" | ITFDGRNNYNPSLKS | 304 |
| VH CDR H3 "MCSP M4-3(B8)" | FDY | 282 |
| Parental VH MCSP M4-3 | QVQLQESGPGLVKPSQTLSLTCTVSGGSITS GYYWNWIRQHPGKGLEWIGYITYDGSNNY NPSLKSRVTISRDTSKNQFSLKLSSVTAADT AVYYCADFDYWGQGTLVTVSS | 308 |
| VL "MCSP ML2(E10)" | DIQMTQSPSSLSASVGDRVTITCRASYGIRG YLNWYQQKPGKAPKLLIYYTSSLHSGVPSR FSGSGSGTDFTLTISSLQPEDFATYHCQQYS KLPWTFGQGTKVEIK | 309 |
| VL CDR L1 "MCSP ML2(E10)" | RASYGIRGYLN | 310 |
| VL CDR L2 "MCSP ML2(E10)" | YTSSLHS | 285 |
| VL CDR L3 "MCSP ML2(E10)" | QQYSKLPWT | 311 |
| VL "MCSP ML2(E10-G3)" | DIQMTQSPSSLSASVGDRVTITCRASYGIRG YLNWYQQKPGKAPKLLIYYTSSLHSGVPSR FSGSGSGTDFTLTISSLQPEDFATYHCQQYS ALPWTFGQGTKVEIK | 312 |
| VL CDR L1 "MCSP ML2(E10-G3)" | RASYGIRGYLN | 310 |
| VL CDR L2 "MCSP ML2(E10-G3)" | YTSSLHS | 285 |
| VL CDR L3 "MCSP ML2(E10-G3)" | QQYSKLPWT | 311 |
| VL "MCSP ML2(C5)" | DIQMTQSPSSLSASVGDRVTITCRASRGIRE YLNWYQQKPGKAPKLLIYYTGSLHSGVPS RFSGSGSGTDFTLTISSLQPEDFATYYCQQY SELPWTFGQGTKVEIK | 313 |
| VL CDR L1 "MCSP ML2(C5)" | RASRGIREYLN | 314 |
| VL CDR L2 "MCSP ML2(C5)" | YTGSLHS | 315 |

| Protein sequences | | |
|---|---|---|
| VL CDR L3 „MCSP $_{ML2(C5)}$" | QQYSELPWT | 316 |
| VL „MCSP $_{ML2(C5-G3)}$" | DIQMTQSPSSLSASVGDRVTITCRASRGIRE YLNWYQQKPGKAPKLLIYYTGSLHSGVPS RFSGSGSGTDFTLTISSLQPEDFATYYCQQY SALPWTFGQGTKVEIK | 317 |
| VL CDR L1 „MCSP $_{ML2(C5-G3)}$" | RASRGIREYLN | 314 |
| VL CDR L2 „MCSP $_{ML2(C5-G3)}$" | YTGSLHS | 315 |
| VL CDR L3 „MCSP $_{ML2(C5-G3)}$" | QQYSKLPWT | 311 |
| Parental VL MCSP $_{ML2}$ | DIQMTQSPSSLSASVGDRVTITCRASQGIRN YLNWYQQKPGKAPKLLIYYTSSLHSGVPSR FSGSGSGTDFTLTISSLQPEDFATYYCQQYS KLPWTFGQGTKVEIK | 318 |
| Exemplary MCSP_CD3 bispecific antibodies | | SEQ ID NO. |
| Light chain „MCSP $_{ML2(G3)}$" | DIQMTQSPSSLSASVGDRVTITCRASQGIRNYL NWYQQKPGKAPKLLIYYTSSLHSGVPSRFSGS GSGTDYTLTISSLQPEDFATYYCQQYSALPWT FGQGTKVEIKRTVAAPSVFIFPPSDEQLKSGTA SVVCLLNNFYPREAKVQWKVDNALQSGNSQE SVTEQDSKDSTYSLSSTLTLSKADYEKHKVYA CEVTHQGLSSPVTKSFNRGEC | 278 |
| Light Chain humanized CD3 $_{CH2527}$ (Crossfab, VL-CH1) | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVLSSASTKGPSVFPLAPSS KSTSGGTAALGCLVKDYFPEPVTVSWNSGALT SGVHTFPAVLQSSGLYSLSSVVTVPSSSLGTQT YICNVNHKPSNTKVDKKVEPKSC | 319 |
| MCSP $_{M4-3(C1)}$ (VH-CH1)-humanized CD3 $_{CH2527}$ (Crossfab VH-Ck)-Fc(knob) P329GLALA | QVQLQESGPGLVKPSQTLSLTCTVSGGSITSGY YWNWIRQHPGKGLEWIGYITFDGSNNYNPSL KSRVTISRDTSKNQFSLKLSSVTAADTAVYYC ADFDYWGQGTLVTVSSASTKGPSVFPLAPSSK STSGGTAALGCLVKDYFPEPVTVSWNSGALTS GVHTFPAVLQSSGLYSLSSVVTVPSSSLGTQTY ICNVNHKPSNTKVDKKVEPKSCDGGGGSGGG GSEVQLLESGGGLVQPGGSLRLSCAASGFTFST YAMNWVRQAPGKGLEWVSRIRSKYNNYATY YADSVKGRFTISRDDSKNTLYLQMNSLRAEDT AVYYCVRHGNFGNSYVSWFAYWGQGTLVTV SSASVAAPSVFIFPPSDEQLKSGTASVVCLLNN FYPREAKVQWKVDNALQSGNSQESVTEQDSK DSTYSLSSTLTLSKADYEKHKVYACEVTHQGL SSPVTKSFNRGECDKTHTCPPCPAPEAAGGPSV FLFPPKPKDTLMISRTPEVTCVVVDVSHEDPEV KFNWYVDGVEVHNAKTKPREEQYNSTYRVV SVLTVLHQDWLNGKEYKCKVSNKALGAPIEK TISKAKGQPREPQVYTLPPCRDELTKNQVSLW CLVKGFYPSDIAVEWESNGQPENNYKTTPPVL DSDGSFFLYSKLTVDKSRWQQGNVFSCSVMH EALHNHYTQKSLSLSPGK | 320 |
| MCSP $_{M4-3(C1)}$ (VH-CH1)-Fc(hole) P329GLALA | QVQLQESGPGLVKPSQTLSLTCTVSGGSITSGY YWNWIRQHPGKGLEWIGYITFDGSNNYNPSL KSRVTISRDTSKNQFSLKLSSVTAADTAVYYC ADFDYWGQGTLVTVSSASTKGPSVFPLAPSSK STSGGTAALGCLVKDYFPEPVTVSWNSGALTS GVHTFPAVLQSSGLYSLSSVVTVPSSSLGTQTY ICNVNHKPSNTKVDKKVEPKSCDKTHTCPPCP APEAAGGPSVFLFPPKPKDTLMISRTPEVTCVV VDVSHEDPEVKFNWYVDGVEVHNAKTKPREE QYNSTYRVVSVLTVLHQDWLNGKEYKCKVS NKALGAPIEKTISKAKGQPREPQVCTLPPSRDE LTKNQVSLSCAVKGFYPSDIAVEWESNGQPEN NYKTTPPVLDSDGSFFLVSKLTVDKSRWQQG NVFSCSVMHEALHNHYTQKSLSLSPGK | 321 |

| Protein sequences | | |
|---|---|---|
| Light Chain humanized CD3 $_{CH2527}$ (Crossfab, VL-CH1) | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVLSSASTKGPSVFPLAPSS KSTSGGTAALGCLVKDYFPEPVTVSWNSGALT SGVHTFPAVLQSSGLYSLSSVVTVPSSSLGTQT YICNVNHKPSNTKVDKKVEPKSC | 369 |
| aVH $_{(MCSP)}$-humanized CD3 $_{CH2527}$ (VH-CK)- Fc(knob) P329GLALA | EVQLVESGGGLVQPGGSLRLSCAASGFNIKDT YIGWVRRAPGKGTELVARIYPTNGYTRYADS VKGRFTISADTSKNTAYLQMNSLRAEDTAVY YCARTSWGGWLSGDYWGQGTLVTVSSGGGG SGGGGSEVQLLESGGGLVQPGGSLRLSCAASG FTFSTYAMNWVRQAPGKGLEWVSRIRSKYNN YATYYADSVKGRFTISRDDSKNTLYLQMNSLR AEDTAVYYCVRHGNFGNSYVSWFAYWGQGT LVTVSSASVAAPSVFIFPPSDEQLKSGTASVVC LLNNFYPREAKVQWKVDNALQSGNSQESVTE QDSKDSTYSLSSTLTLSKADYEKHKVYACEVT HQGLSSPVTKSFNRGECDKTHTCPPCPAPEAA GGPSVFLFPPKPKDTLMISRTPEVTCVVVDVSH EDPEVKFNWYVDGVEVHNAKTKPREEQYNST YRVVSVLTVLHQDWLNGKEYKCKVSNKALG APIEKTISKAKGQPREPQVYTLPPCRDELTKNQ VSLWCLVKGFYPSDIAVEWESNGQPENNYKT TPPVLDSDGSFFLYSKLTVDKSRWQQGNVFSC SVMHEALHNHYTQKSLSLSPGK | 370 |
| aVH $_{(MCSP)}$-Fc(hole) P329GLALA | EVQLVESGGGLVQPGGSLRLSCAASGFNIKDT YIGWVRRAPGKGTELVARIYPTNGYTRYADS VKGRFTISADTSKNTAYLQMNSLRAEDTAVY YCARTSWGGWLSGDYWGQGTLVTVSSDKTH TCPPCPAPEAAGGPSVFLFPPKPKDTLMISRTPE VTCVVVDVSHEDPEVKFNWYVDGVEVHNAK TKPREEQYNSTYRVVSVLTVLHQDWLNGKEY KCKVSNKALGAPIEKTISKAKGQPREPQVCTLP PSRDELTKNQVSLSCAVKGFYPSDIAVEWESN GQPENNYKTTPPVLDSDGSFFLVSKLTVDKSR WQQGNVFSCSVMHEALHNHYTQKSLSLSPGK | 371 |
| Light chain ,,MCSP $_{ML2(G3)}$" | DIQMTQSPSSLSASVGDRVTITCRASQGIRNYL NWYQQKPGKAPKLLIYYTSSLHSGVPSRFSGS GSGTDYTLTISSLQPEDFATYYCQQYSALPWT FGQGTKVEIKRTVAAPSVFIFPPSDEQLKSGTA SVVCLLNNFYPREAKVQWKVDNALQSGNSQE SVTEQDSKDSTYSLSSTLTLSKADYEKHKVYA CEVTHQGLSSPVTKSFNRGEC | 372 |
| Light Chain humanized CD3 $_{CH2527}$ (Crossfab, VL-CH1) | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVLSSASTKGPSVFPLAPSS KSTSGGTAALGCLVKDYFPEPVTVSWNSGALT SGVHTFPAVLQSSGLYSLSSVVTVPSSSLGTQT YICNVNHKPSNTKVDKKVEPKSC | 373 |
| MCSP $_{M4-3(C1)}$-humanized CD3 $_{CH2527}$ (VH-CK)- Fc(DD) P329GLALA | QVQLQESGPGLVKPSQTLSLTCTVSGGSITSGY YWNWIRQHPGKGLEWIGYITFDGSNNYNPSL KSRVTISRDTSKNQFSLKLSSVTAADTAVYYC ADFDYWGQGTLVTVSSASTKGPSVFPLAPSSK STSGGTAALGCLVKDYFPEPVTVSWNSGALTS GVHTFPAVLQSSGLYSLSSVVTVPSSSLGTQTY ICNVNHKPSNTKVDKKVEPKSCDGGGSGGG GSEVQLLESGGGLVQPGGSLRLSCAASGFTFST YAMNWVRQAPGKGLEWVSRIRSKYNNYATY YADSVKGRFTISRDDSKNTLYLQMNSLRAEDT AVYYCVRHGNFGNSYVSWFAYWGQGTLVTV SSASVAAPSVFIFPPSDEQLKSGTASVVCLLNN FYPREAKVQWKVDNALQSGNSQESVTEQDSK DSTYSLSSTLTLSKADYEKHKVYACEVTHQGL SSPVTKSFNRGECDKTHTCPPCPAPEAAGGPSV FLFPPKPKDTLVIISRTPEVTCVVVDVSHEDPEV KFNWYVDGVEVHNAKTKPREEQYNSTYRVV SVLTVLHQDWLNGKEYKCKVSNKALGAPIEK TISKAKGQPREPQVYTLPPSRDELTKNQVSLTC | 374 |

| Protein sequences | | |
|---|---|---|
| | LVKGFYPSDIAVEWESNGQPENNYDTTPPVLD SDGSFFLYSDLTVDKSRWQQGNVFSCSVMHE ALHNHYTQKSLSLSPGK | |
| MCSP $_{M4-3(C1)}$-Fc(KK) P329GLALA | QVQLQESGPGLVKPSQTLSLTCTVSGGSITSGY YWNWIRQHPGKGLEWIGYITYDGSNNYNPSL KSRVTISRDTSKNQFSLKLSSVTAADTAVYYC ADFDYWGQGTLVTVSSASTKGPSVFPLAPSSK STSGGTAALGCLVKDYFPEPVTVSWNSGALTS GVHTFPAVLQSSGLYSLSSVVTVPSSSLGTQTY ICNVNHKPSNTKVDKKVEPKSCDKTHTCPPCP APEAAGGPSVFLFPPKPKDTLMISRTPEVTCVV VDVSHEDPEVKFNWYVDGVEVHNAKTKPREE QYNSTYRVVSVLTVLHQDWLNGKEYKCKVS NKALGAPIEKTISKAKGQPREPQVYTLPPSRKE LTKNQVSLTCLVKGFYPSDIAVEWESNGQPEN NYKTTPPVLKSDGSFFLYSKLTVDKSRWQQG NVFSCSVMHEALHNHYTQKSLSLSPGK | 375 |

| Exemplary CEA_CD3 bispecific antibody | | SEQ ID NO. |
|---|---|---|
| Light chain ,,CEA $_{2F1}$" | DIQMTQSPSSLSASVGDRVTITCKASAAVGTY VAWYQQKPGKAPKLLIYSASYRKRGVPSRFSG SGSGTDFTLTISSLQPEDFATYYCHQYYTYPLF TFGQGTKLEIKRTVAAPSVFIFPPSDEQLKSGT ASVVCLLNNFYPREAKVQWKVDNALQSGNSQ ESVTEQDSKDSTYSLSSTLTLSKADYEKHKVY ACEVTHQGLSSPVTKSFNRGEC | 288 |
| Light Chain humanized CD3 $_{CH2527}$ (Crossfab, VL-CH1) | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVLSSASTKGPSVFPLAPSS KSTSGGTAALGCLVKDYFPEPVTVSWNSGALT SGVHTFPAVLQSSGLYSLSSVVTVPSSSLGTQT YICNVNHKPSNTKVDKKVEPKSC | 322 |
| CEA $_{CH1A1A\ 98/99}$-humanized CD3 $_{CH2527}$ (Crossfab VH-Ck)-Fc(knob) P329GLALA | QVQLVQSGAEVKKPGASVKVSCKASGYTFTE FGMNWVRQAPGQGLEWMGWINTKTGEATYV EEFKGRVTFTTDTSTSTAYMELRSLRSDDTAV YYCARWDFAYYVEAMDYWGQGTTVTVSSAS TKGPSVFPLAPSSKSTSGGTAALGCLVKDYFPE PVTVSWNSGALTSGVHTFPAVLQSSGLYSLSS VVTVPSSSLGTQTYICNVNHKPSNTKVDKKVE PKSCDGGGGSGGGGSEVQLLESGGGLVQPGG SLRLSCAASGFTFSTYAMNWVRQAPGKGLEW VSRIRSKYNNYATYYADSVKGRFTISRDDSKN TLYLQMNSLRAEDTAVYYCVRHGNFGNSYVS WFAYWGQGTLVTVSSASVAAPSVFIFPPSDEQ LKSGTASVVCLLNNFYPREAKVQWKVDNALQ SGNSQESVTEQDSKDSTYSLSSTLTLSKADYEK HKVYACEVTHQGLSSPVTKSFNRGECDKTHT CPPCPAPEAAGGPSVFLFPPKPKDTLMISRTPE VTCVVVDVSHEDPEVKFNWYVDGVEVHNAK TKPREEQYNSTYRVVSVLTVLHQDWLNGKEY KCKVSNKALGAPIEKTISKAKGQPREPQVYTL PPCRDELTKNQVSLWCLVKGFYPSDIAVEWES NGQPENNYKTTPPVLDSDGSFFLYSKLTVDKS RWQQGNVFSCSVMHEALHNHYTQKSLSLSPG K | 323 |
| CEA $_{CH1A1A\ 98/99}$ (VH-CH1)-Fc(hole) P329GLALA | QVQLVQSGAEVKKPGASVKVSCKASGYTFTE FGMNWVRQAPGQGLEWMGWINTKTGEATYV EEFKGRVTFTTDTSTSTAYMELRSLRSDDTAV YYCARWDFAYYVEAMDYWGQGTTVTVSSAS TKGPSVFPLAPSSKSTSGGTAALGCLVKDYFPE PVTVSWNSGALTSGVHTFPAVLQSSGLYSLSS VVTVPSSSLGTQTYICNVNHKPSNTKVDKKVE PKSCDKTHTCPPCPAPEAAGGPSVFLFPPKPKD TLMISRTPEVTCVVVDVSHEDPEVKFNWYVD GVEVHNAKTKPREEQYNSTYRVVSVLTVLHQ DWLNGKEYKCKVSNKALGAPIEKTISKAKGQP REPQVCTLPPSRDELTKNQVSLSCAVKGFYPS DIAVEWESNGQPENNYKTTPPVLDSDGSFFLV SKLTVDKSRWQQGNVFSCSVMHEALHNHYTQ KSLSLSPGK | 324 |

| Protein sequences | | |
|---|---|---|
| Untargeted DP47 | | SEQ ID NO. |
| Light Chain DP47 GS | EIVLTQSPGTLSLSPGERATLSCRASQSVSSS YLAWYQQKPGQAPRLLIYGASSRATGIPDR FSGSGSGTDFTLTISRLEPEDFAVYYCQQYG SSPLTFGQGTKVEIKRTVAAPSVFTFPPSDEQ LKSGTASVVCLLNNFYPREAKVQWKVDNA LQSGNSQESVTEQDSKDSTYSLSSTLTLSKA DYEKHKVYACEVTHQGLSSPVTKSFNRGE C | 325 |
| Light Chain humanized CD3 $_{CH2527}$ (Crossfab, VL-CH1 | QAVVTQEPSLTVSPGGTVTLTCGSSTGAVT TSNYANWVQEKPGQAFRGLIGGTNKRAPG TPARFSGSLLGGKAALTLSGAQPEDEAEYY CALWYSNLWVFGGGTKLTVLSSASTKGPS VFPLAPSSKSTSGGTAALGCLVKDYFPEPVT VSWNSGALTSGVHTFPAVLQSSGLYSLSSV VTVPSSSLGTQTYICNVNHKPSNTKVDKKV EPKSC | 326 |
| DP47 GS (VH-CH1)-humanized CD3 $_{Ch2527}$ (Crossfab VH-Ck)-Fc(knob) P329GLALA | EVQLLESGGGLVQPGGSLRLSCAASGFTFSS YAMSWVRQAPGKGLEWVSAISGSGGSTYY ADSVKGRFTISRDNSKNTLYLQMNSLRAED TAVYYCAKGSGFDYWGQGTLVTVSSASTK GPSVFPLAPSSKSTSGGTAALGCLVKDYFPE PVTVSWNSGALTSGVHTFPAVLQSSGLYSL SSVVTVPSSSLGTQTYICNVNHKPSNTKVD KKVEPKSCDGGGGSGGGGSEVQLLESGGG LVQPGGSLRLSCAASGFTFSTYAMNWVRQ APGKGLEWVSRIRSKYNNYATYYADSVKG RFTISRDDSKNTLYLQMNSLRAEDTAVYYC VRHGNFGNSYVSWFAYWGQGTLVTVSSAS VAAPSVFIFPPSDEQLKSGTASVVCLLNNFY PREAKVQWKVDNALQSGNSQESVTEQDSK DSTYSLSSTLTLSKADYEKHKVYACEVTHQ GLSSPVTKSFNRGECDKTHTCPPCPAPEAA GGPSVFLFPPKPKDTLMISRTPEVTCVVVDV SHEDPEVKFNWYVDGVEVHNAKTKPREEQ YNSTYRVVSVLTVLHQDWLNGKEYKCKVS NKALGAPIEKTISKAKGQPREPQVYTLPPCR DELTKNQVSLWCLVKGFYPSDIAVEWESN GQPENNYKTTPPVLDSDGSFFLYSKLTVDK SRWQQGNVFSCSVMHEALHNHYTQKSLSL SPGK | 327 |
| DP47 GS (VH-CH1)-Fc(hole) P329GLALA | EVQLLESGGGLVQPGGSLRLSCAASGFTFSS YAMSWVRQAPGKGLEWVSAISGSGGSTYY ADSVKGRFTISRDNSKNTLYLQMNSLRAED TAVYYCAKGSGFDYWGQGTLVTVSSASTK GPSVFPLAPSSKSTSGGTAALGCLVKDYFPE PVTVSWNSGALTSGVHTFPAVLQSSGLYSL SSVVTVPSSSLGTQTYICNVNHKPSNTKVD KKVEPKSCDKTHTCPPCPAPEAAGGPSVFL FPPKPKDTLMISRTPEVTCVVVDVSHEDPE VKFNWYVDGVEVHNAKTKPREEQYNSTY RVVSVLTVLHQDWLNGKEYKCKVSNKAL GAPIEKTISKAKGQPREPQVCTLPPSRDELT KNQVSLSCAVKGFYPSDIAVEWESNGQPEN NYKTTPPVLDSDGSFFLVSKLTVDKSRWQQ GNVFSCSVMHEALHNHYTQKSLSLSPGK | 328 |
| Exemplary Darpin T-cell bispecific antibody | | SEQ ID NO. |
| Light Chain humanized CD3 $_{CH2527}$ (Crossfab, VL-CH1) | QAVVTQEPSLTVSPGGTVTLTCGSSTGAVTTS NYANWVQEKPGQAFRGLIGGTNKRAPGTPAR FSGSLLGGKAALTLSGAQPEDEAEYYCALWY SNLWVFGGGTKLTVLSSASTKGPSVFPLAPSS KSTSGGTAALGCLVKDYFPEPVTVSWNSGALT SGVHTFPAVLQSSGLYSLSSVVTVPSSSLGTQT YICNVNHKPSNTKVDKKVEPKSC | 376 |
| Darpin $_{(HER2)}$-humanized CD3 $_{CH2527}$ (VH-CK)-Fc(knob) P329GLALA | DLGKKLLEAARAGQDDEVRILMANGADVNA KDEYGLTPLYLATAHGHLEIVEVLLKNGADV NAVDAIGFTPLHLAAFIGHLEIAEVLLKHGAD VNAQDKFGKTAFDISIGNGNEDLAEILQKLGG | 377 |

-continued

| | Protein sequences | |
|---|---|---|
| | GGSGGGGSEVQLLESGGGLVQPGGSLRLSCAA<br>SGFTFSTYAMNWVRQAPGKGLEWVSRIRSKY<br>NNYATYYADSVKGRFTISRDDSKNTLYLQMN<br>SLRAEDTAVYYCVRHGNFGNSYVSWFAYWG<br>QGTLVTVSSASVAAPSVFIFPPSDEQLKSGTAS<br>VVCLLNNFYPREAKVQWKVDNALQSGNSQES<br>VTEQDSKDSTYSLSSTLTLSKADYEKHKVYAC<br>EVTHQGLSSPVTKSFNRGECDKTHTCPPCPAPE<br>AAGGPSVFLFPPKPKDTLMISRTPEVTCVVVD<br>VSHEDPEVKFNWYVDGVEVHNAKTKPREEQY<br>NSTYRVVSVLTVLHQDWLNGKEYKCKVSNK<br>ALGAPIEKTISKAKGQPREPQVYTLPPCRDELT<br>KNQVSLWCLVKGFYPSDIAVEWESNGQPENN<br>YKTTPPVLDSDGSFFLYSKLTVDKSRWQQGN<br>VFSCSVMHEALHNHYTQKSLSLSPGK | |
| Darpin (HER2)-Fc(hole)<br>P329GLALA | DLGKKLLEAARAGQDDEVRILMANGADVNA<br>KDEYGLTPLYLATAHGHLEIVEVLLKNGADV<br>NAVDAIGFTPLHLAAFIGHLEIAEVLLKHGAD<br>VNAQDKFGKTAFDISIGNGNEDLAEILQKLDK<br>THTCPPCPAPEAAGGPSVFLFPPKPKDTLMISR<br>TPEVTCVVVDVSHEDPEVKFNWYVDGVEVHN<br>AKTKPREEQYNSTYRVVSVLTVLHQDWLNGK<br>EYKCKVSNKALGAPIEKTISKAKGQPREPQVC<br>TLPPSRDELTKNQVSLSCAVKGFYPSDIAVEW<br>ESNGQPENNYKTTPPVLDSDGSFFLVSKLTVD<br>KSRWQQGNVFSCSVMHEALHNHYTQKSLSLS<br>PGK | 378 |
| D3 domain of cynomologus<br>MCSP (extracellular part) | LSLEGSRTLTVCPGSVQPLSSQTLRASSSAGTD<br>PQLLLYRVVRGPQLGRLFHAQQDSTGEALVN<br>FTQAEVYAGNILYEHEMPTEPFWEAHDTLEL<br>QLSSPPARDVAATLAVAVSFEAACPQRPSHL<br>WKNKGLWVPEGQRAKITMAALDASNLLASV<br>PSPQRLEHDVLFQVTQFPSRGQLLVSEEPLHA<br>GQPHFLQSQLAAGQLVYAHGGGGTQQDGFH<br>FRAHLQGPAGATVAGPQTSEAFAITVRDVNE<br>RPPQPQASVPLRITRGSRAPISRAQLSVVDPDS<br>APGEIEYEVQRAPHNGFLSLVGGGPGPVTHFT<br>QADVDSGRLAFVANGSSVAGVFQLSMSDGAS<br>PPLPMSLAVDILPSAIEVQLQAPLEVPQALGRS<br>SLSQQQLRVVSDREEPEAAYRLIQGPKYGHLL<br>VGGRPASAFSQLQIDQGEVVFAFTNFSSSHDH<br>FRVLALARGVNASAVVNITVRALLHVWAGG<br>PWPQGATLRLDPTILDAGELANRTGSVPHFRL<br>LEGPRHGRVVRVPRARTEPGGSQLVEQFTQQ<br>DLEDGRLGLEVGRPEGRAPSPTGDSLTLELW<br>AQGVPPAVASLDFATEPYNAARPYSVALLSV<br>PEATRMEAGKPESSTPTGEPGPMASSPVPAVA<br>KGGFLGFLEANMFS | 389 |
| D3 domain of human MCSP<br>(extracellular part) | LSLKGSQTLTVCPGSVQPLSSQTLRASSSAGT<br>DPQLLLYRVVRGPQLGRLFHAQQDSTGEALV<br>NFTQAEVYAGNILYEHEMPPEPFWEAHDTLE<br>LQLSSPPARDVAATLAVAVSFEAACPQHPSHL<br>WKNKGLWVPEGQRARITVAALDASNLLASV<br>PSPQRSEHDVLFQVTQFPSRGQLLVSEEPLHA<br>GQPHFLQSQLAAGQLVYAHGGGGTQQDGFH<br>FRAHLQGPAGASVAGPQTSEAFAITVRDVNE<br>RPPQPQASVPLRLTRGSRAPISRAQLSWDPDS<br>APGEIEYEVQRAPHNGFLSLVGGGLGPVTRFT<br>QADVDSGRLAFVANGSSVAGIFQLSMSDGAS<br>PPLPMSLAVDILPSAIEVQLRAPLEVPQALGRS<br>SLSQQQLRVVSDREEPEAAYRLIQGPQYGHLL<br>VGGRPTSAFSQFQIDQGEVVFAFTNFSSSHDH<br>FRVLALARGVNASAVVNVTVRALLHVWAGG<br>PWPQGATLRLDPTVLDAGELANRTGSVPRFR<br>LLEGPRHGRVVRVPRARTEPGGSQLVEQFTQ<br>QDLEDGRLGLEVGRPEGRAPGPAGDSLTLEL<br>WAQGVPPAVASLDFATEPYNAARPYSVALLS<br>VPEAARTEAGKPESSTPTGEPGPMASSPEPAV<br>AKGGFLSFLEANMFS | 390 |

| DNA sequences | | |
|---|---|---|
| CD3 CH2527 (VL 7-46(13) /VH 3-23(12)) | | |
| Heavy chain "CD3 CH2527 (VH_3-23(12))" | ATGGGATGGAGCTGTATCATCCTCTTCTT GGTAGCAACAGCTACCGGTGTGCATTCC GAGGTGCAGCTGCTGGAATCTGGCGGCG GACTGGTGCAGCCTGGCGGATCTCTGAG ACTGAGCTGTGCCGCCAGCGGCTTCACCT TCAGCACCTACGCCATGAACTGGGTGCG CCAGGCCCCTGGCAAAGGCCTGGAATGG GTGTCCCGGATCAGAAGCAAGTACAACA ACTACGCCACCTACTACGCCGACAGCGT GAAGGGCCGGTTCACCATCAGCCGGGAC GACAGCAAGAACACCCTGTACCTGCAGA TGAACAGCCTGCGGGCCGAGGACACCGC CGTGTACTATTGTGTGCGGCACGGCAACT TCGGCAACAGCTATGTGTCTTGGTTTGCC TACTGGGGCCAGGGCACCCTCGTGACCG TGTCATCTGCTAGCACCAAGGGCCCATCG GTCTTCCCCCTGGCACCCTCCTCCAAGAG CACCTCTGGGGGCACAGCGGCCCTGGGC TGCCTGGTCAAGGACTACTTCCCCGAACC GGTGACGGTGTCGTGGAACTCAGGCGCC CTGACCAGCGGCGTGCACACCTTCCCGG CTGTCCTACAGTCCTCAGGACTCTACTCC CTCAGCAGCGTGGTGACCGTGCCCTCCA GCAGCTTGGGCACCCAGACCTACATCTG CAACGTGAATCACAAGCCCAGCAACACC AAGGTGGACAAGAAAGTTGAGCCCAAAT CTTGTGACAAAACTCACACATGCCCACC GTGCCCAGCACCTGAACTCCTGGGGGGA CCGTCAGTCTTCCTCTTCCCCCCAAAACC CAAGGACACCCTCATGATCTCCCGGACC CCTGAGGTCACATGCGTGGTGGTGGACG TGAGCCACGAAGACCCTGAGGTCAAGTT CAACTGGTACGTGGACGGCGTGGAGGTG CATAATGCCAAGACAAAGCCGCGGGAGG AGCAGTACAACAGCACGTACCGTGTGGT CAGCGTCCTCACCGTCCTGCACCAGGACT GGCTGAATGGCAAGGAGTACAAGTGCAA GGTCTCCAACAAAGCCCTCCCAGCCCCC ATCGAGAAAACCATCTCCAAAGCCAAAG GGCAGCCCCGAGAACCACAGGTGTACAC CCTGCCCCCATCCCGGGATGAGCTGACC AAGAACCAGGTCAGCCTGACCTGCCTGG TCAAAGGCTTCTATCCCAGCGACATCGCC GTGGAGTGGGAGAGCAATGGGCAGCCGG AGAACAACTACAAGACCACGCCTCCCGT GCTGGACTCCGACGGCTCCTTCTTCCTCT ACAGCAAGCTCACCGTGGACAAGAGCAG GTGGCAGCAGGGGAACGTCTTCTCATGC TCCGTGATGCATGAGGCTCTGCACAACC ACTACACGCAGAAGAGCCTCTCCCTGTCT CCGGGTAAATGA | 329 |
| Light chain "CD3 CH2527 (VL_7-46(13))" | ATGGGATGGAGCTGTATCATCCTCTTCTT GGTAGCAACAGCTACCGGTGTGCATTCTC AGGCCGTCGTGACCCAGGAACCCAGCCT GACAGTGTCTCCTGGCGGCACCGTGACC CTGACATGTGGCAGTTCTACAGGCGCCGT GACCACCAGCAACTACGCCAACTGGGTG CAGGAAAAGCCCGGCCAGGCCTTCAGAG GACTGATCGGCGGCACCAACAAGAGAGC CCCTGGCACCCCTGCCAGATTCAGCGGAT CTCTGCTGGGAGGAAAGGCCGCCCTGAC ACTGTCTGGCGCCCAGCCAGAAGATGAG GCCGAGTACTACTGCGCCCTGTGGTACA GCAACCTGTGGGTGTTCGGCGGAGGCAC CAAGCTGACAGTCCTAGGTCAACCCAAG GCTGCCCCCAGCGTGACCCTGTTCCCCCC CAGCAGCGAGGAACTGCAGGCCAACAAG GCCACCCTGGTCTGCCTGATCAGCGACTT CTACCCAGGCGCCGTGACCGTGGCCTGG AAGGCCGACAGCAGCCCCGTGAAGGCCG GCGTGGAGACCACCACCCCCAGCAAGCA GAGCAACAACAAGTACGCCGCCAGCAGC TACCTGAGCCTGACCCCCGAGCAGTGGA AGAGCCACAGGTCCTACAGCTGCCAGGT GACCCACGAGGGCAGCACCGTGGAGAAA ACCGTGGCCCCCACCGAGTGCAGCTGA | 330 |

| | DNA sequences | |
|---|---|---|
| VH<br>"CD3 CH2527 (VH_3-23(12))" | ATGGGATGGAGCTGTATCATCCTCTTCTT<br>GGTAGCAACAGCTACCGGTGTGCATTCC<br>GAGGTGCAGCTGCTGGAATCTGGCGGCG<br>GACTGGTGCAGCCTGGCGGATCTCTGAG<br>ACTGAGCTGTGCCGCCAGCGGCTTCACCT<br>TCAGCACCTACGCCATGAACTGGGTGCG<br>CCAGGCCCCTGGCAAAGGCCTGGAATGG<br>GTGTCCCGGATCAGAAGCAAGTACAACA<br>ACTACGCCACCTACTACGCCGACAGCGT<br>GAAGGGCCGGTTCACCATCAGCCGGGAC<br>GACAGCAAGAACACCCTGTACCTGCAGA<br>TGAACAGCCTGCGGGCCGAGGACACCGC<br>CGTGTACTATTGTGTGCGGCACGGCAACT<br>TCGGCAACAGCTATGTGTCTTGGTTTGCC<br>TACTGGGGCCAGGGCACCCTCGTGACCG<br>TGTCATCT | 331 |
| VH CDR H1<br>"CD3 CH2527 (VH_3-23(12))" | ACCTACGCCATGAAC | 332 |
| VH CDR H2<br>"CD3 CH2527 (VH_3-23(12))" | CGGATCAGAAGCAAGTACAACAACTACG<br>CCACCTACTACGCCGACAGCGTGAAGGG<br>C | 333 |
| VH CDR H3<br>"CD3 CH2527 (VH_3-23(12))" | CACGGCAACTTCGGCAACAGCTATGTGT<br>CTTGGTTTGCCTAC | 334 |
| VL<br>"CD3 CH2527 (VL_7-46(13))" | ATGGGATGGAGCTGTATCATCCTCTTCTT<br>GGTAGCAACAGCTACCGGTGTGCATTCTC<br>AGGCCGTCGTGACCCAGGAACCCAGCCT<br>GACAGTGTCTCCTGGCGGCACCGTGACC<br>CTGACATGTGGCAGTTCTACAGGCGCCGT<br>GACCACCAGCAACTACGCCAACTGGGTG<br>CAGGAAAAGCCCGGCCAGGCCTTCAGAG<br>GACTGATCGGCGGCACCAACAAGAGAGC<br>CCCTGGCACCCCTGCCAGATTCAGCGGAT<br>CTCTGCTGGGAGGAAAGGCCGCCCTGAC<br>ACTGTCTGGCGCCCAGCCAGAAGATGAG<br>GCCGAGTACTACTGCGCCCTGTGGTACA<br>GCAACCTGTGGGTGTTCGGCGGAGGCAC<br>CAAGCTGACAGTCCTA | 335 |
| VL CDR L1<br>"CD3 CH2527 (VL_7-46(13))" | GGCAGTTCTACAGGCGCCGTGACCACCA<br>GCAACTACGCCAAC | 336 |
| VL CDR L2<br>"CD3 CH2527 (VL_7-46(13))" | GGCACCAACAAGAGAGCCCCT | 337 |
| VL CDR L3<br>"CD3 CH2527 (VL_7-46(13))" | GCCCTGTGGTACAGCAACCTGTGGGTG | 338 |
| MCSP M4-3(C1)ML2(G3) | | |
| Heavy chain<br>,,MCSP M4-3(C1)" | ATGGGATGGAGCTGTATCATCCTCTTCTT<br>GGTAGCAACAGCTACCGGTGTGCATTCC<br>CAGGTGCAATTGCAGGAAAGCGGCCCTG<br>GCCTGGTCAAGCCCAGCCAGACCCTGAG<br>CCTGACCTGCACCGTGTCCGGCGGCAGC<br>ATCACCAGCGGCTATTATTGGAACTGGAT<br>TCGGCAGCACCCCGGCAAGGGCCTGGAA<br>TGGATCGGCTACATCACTTTCGACGGCTC<br>TAACAACTACAACCCCAGCCTGAAGTCC<br>AGAGTGACCATCAGCCGGGACACCAGCA<br>AGAACCAGTTCAGCCTGAAGCTGTCCAG<br>CGTGACAGCCGCCGACACCGCCGTGTAC<br>TACTGCGCCGACTTCGACTACTGGGGCCA<br>GGGCACCCTGGTCACCGTGTCCAGCGCT<br>AGCACCAAGGGCCCATCGGTCTTCCCCCT<br>GGCACCCTCCTCCAAGAGCACCTCTGGG<br>GGCACAGCGGCCCTGGGCTGCCTGGTCA<br>AGGACTACTTCCCCGAACCGGTGACGGT<br>GTCGTGGAACTCAGGCGCCCTGACCAGC<br>GGCGTGCACACCTTCCCGGCTGTCCTACA<br>GTCCTCAGGACTCTACTCCCTCAGCAGCG<br>TGGTGACCGTGCCCTCCAGCAGCTTGGGC<br>ACCCAGACCTACATCTGCAACGTGAATC<br>ACAAGCCCAGCAACACCAAGGTGGACAA | 339 |

-continued

| | DNA sequences | |
|---|---|---|
| | GAAAGTTGAGCCCAAATCTTGTGACAAA<br>ACTCACACATGCCCACCGTGCCCAGCAC<br>CTGAACTCCTGGGGGACCGTCAGTCTTC<br>CTCTTCCCCCCAAAACCCAAGGACACCCT<br>CATGATCTCCCGGACCCCTGAGGTCACAT<br>GCGTGGTGGTGGACGTGAGCCACGAAGA<br>CCCTGAGGTCAAGTTCAACTGGTACGTG<br>GACGGCGTGGAGGTGCATAATGCCAAGA<br>CAAAGCCGCGGGAGGAGCAGTACAACAG<br>CACGTACCGTGTGGTCAGCGTCCTCACCG<br>TCCTGCACCAGGACTGGCTGAATGGCAA<br>GGAGTACAAGTGCAAGGTCTCCAACAAA<br>GCCCTCCCAGCCCCCATCGAGAAAACCA<br>TCTCCAAAGCCAAAGGGCAGCCCCGAGA<br>ACCACAGGTGTACACCCTGCCCCCATCCC<br>GGGATGAGCTGACCAAGAACCAGGTCAG<br>CCTGACCTGCCTGGTCAAAGGCTTCTATC<br>CCAGCGACATCGCCGTGGAGTGGGAGAG<br>CAATGGGCAGCCGGAGAACAACTACAAG<br>ACCACGCCTCCCGTGCTGGACTCCGACG<br>GCTCCTTCTTCCTCTACAGCAAGCTCACC<br>GTGGACAAGAGCAGGTGGCAGCAGGGG<br>AACGTCTTCTCATGCTCCGTGATGCATGA<br>GGCTCTGCACAACCACTACACGCAGAAG<br>AGCCTCTCCCTGTCTCCGGGTAAATGA | |
| Light chain<br>,,MCSP $_{ML2(G3)}$'' | ATGGGATGGAGCTGTATCATCCTCTTCTT<br>GGTAGCAACAGCTACCGGTGTGCATTCC<br>GACATCCAGATGACCCAGAGCCCCAGCA<br>GCCTGAGCGCCAGCGTGGGCGACAGAGT<br>GACCATCACCTGCCGGGCCAGCCAGGGC<br>ATCCGGAACTACCTGAACTGGTATCAGC<br>AGAAGCCCGGCAAGGCCCCCAAGCTGCT<br>GATCTACTACACCAGCAGCCTGCACAGC<br>GGCGTGCCTAGCCGGTTTAGCGGCAGCG<br>GCTCCGGCACCGACTACACCCTGACCAT<br>TAGCTCCCTGCAGCCCGAGGACTTCGCC<br>ACCTACTACTGCCAGCAGTACTCTGCTCT<br>GCCGTGGACCTTCGGCCAGGGAACAAAG<br>GTGGAGATCAAGCGTACGGTGGCTGCAC<br>CATCTGTCTTCATCTTCCCGCCATCTGAT<br>GAGCAGTTGAAATCTGGAACTGCCTCTG<br>TTGTGTGCCTGCTGAATAACTTCTATCCC<br>AGAGAGGCCAAAGTACAGTGGAAGGTG<br>GATAACGCCCTCCAATCGGGTAACTCCC<br>AGGAGAGTGTCACAGAGCAGGACAGCA<br>AGGACAGCACCTACAGCCTCAGCAGCAC<br>CCTGACGCTGAGCAAAGCAGACTACGAG<br>AAACACAAAGTCTACGCCTGCGAAGTCA<br>CCCATCAGGGCCTGAGCTCGCCCGTCAC<br>AAAGAGCTTCAACAGGGGAGAGTGTTAG | 340 |
| VH<br>,,MCSP $_{M4-3(C1)}$'' | ATGGGATGGAGCTGTATCATCCTCTTCTT<br>GGTAGCAACAGCTACCGGTGTGCATTCC<br>CAGGTGCAATTGCAGGAAAGCGGCCCTG<br>GCCTGGTCAAGCCCAGCCAGACCCTGAG<br>CCTGACCTGCACCGTGTCCGGCGGCAGC<br>ATCACCAGCGGCTATTATTGGAACTGGA<br>TTCGGCAGCACCCCGGCAAGGGCCTGGA<br>ATGGATCGGCTACATCACTTTCGACGGCT<br>CTAACAACTACAACCCCAGCCTGAAGTC<br>CAGAGTGACCATCAGCCGGGACACCAGC<br>AAGAACCAGTTCAGCCTGAAGCTGTCCA<br>GCGTGACAGCCGCCGACACCGCCGTGTA<br>CTACTGCGCCGACTTCGACTACTGGGGC<br>CAGGGCACCCTGGTCACCGTGTCCAGC | 341 |
| VH CDR H1<br>,,MCSP $_{M4-3(C1)}$'' | AGCGGCTATTATTGGAAC | 342 |
| VH CDR H2<br>,,MCSP $_{M4-3(C1)}$'' | TACATCACTTTCGACGGCTCTAACAACTA<br>CAACCCCAGCCTGAAGTCC | 343 |
| VH CDR H3<br>,,MCSP $_{M4-3(C1)}$'' | TTCGACTAC | 344 |

-continued

| DNA sequences | | |
|---|---|---|
| VL "MCSP ML2(G3)" | ATGGGATGGAGCTGTATCATCCTCTTCTT GGTAGCAACAGCTACCGGTGTGCATTCC GACATCCAGATGACCCAGAGCCCCAGCA GCCTGAGCGCCAGCGTGGGCGACAGAGT GACCATCACCTGCCGGGCCAGCCAGGGC ATCCGGAACTACCTGAACTGGTATCAGC AGAAGCCCGGCAAGGCCCCCAAGCTGCT GATCTACTACACCAGCAGCCTGCACAGC GGCGTGCCTAGCCGGTTTAGCGGCAGCG GCTCCGGCACCGACTACACCCTGACCAT TAGCTCCCTGCAGCCCGAGGACTTCGCC ACCTACTACTGCCAGCAGTACTCTGCTCT GCCGTGGACCTTCGGCCAGGGAACAAAG GTGGAGATCAAG | 345 |
| VL CDRL1 "MCSP ML2(G3)" | CGGGCCAGCCAGGGCATCCGGAACTACC TGAAC | 346 |
| VL CDR L2 "MCSP ML2(G3)" | TACACCAGCAGCCTGCACAGCG | 347 |
| VL CDR L3 "MCSP ML2(G3)" | CAGCAGTACTCTGCTCTGCCGTGGACC | 348 |
| CEA CH1A1A 98-99 2F1 | | SEQ ID NO. |
| Heavy chain "CEA CH1A1A 98-99" | ATGGGATGGAGCTGTATCATCCTCTTCTT GGTAGCAACAGCTACCGGTGTGCATTCC CAGGTGCAGCTGGTGCAGTCTGGCGCCG AAGTGAAGAAACCTGGAGCTAGTGTGAA GGTGTCCTGCAAGGCCAGCGGCTACACC TTCACCGAGTTCGGCATGAACTGGGTCC GACAGGCTCCAGGCCAGGGCCTCGAATG GATGGGCTGGATCAACACCAAGACCGGC GAGGCCACCTACGTGGAAGAGTTCAAGG GCAGAGTGACCTTCACCACGGACACCAG CACCAGCACCGCCTACATGGAACTGCGG AGCCTGAGAAGCGACGACACCGCCGTGT ACTACTGCGCCAGATGGGACTTCGCCTA TTACGTGGAAGCCATGGACTACTGGGGC CAGGGCACCACCGTGACCGTGTCTAGCG CTAGCACCAAGGGCCCATCGGTCTTCCC CCTGGCACCCTCCTCCAAGAGCACCTCT GGGGGCACAGCGGCCCTGGGCTGCCTGG TCAAGGACTACTTCCCCGAACCGGTGAC GGTGTCGTGGAACTCAGGCGCCCTGACC AGCGGCGTGCACACCTTCCCGGCTGTCC TACAGTCCTCAGGACTCTACTCCCTCAGC AGCGTGGTGACCGTGCCCTCCAGCAGCT TGGGCACCCAGACCTACATCTGCAACGT GAATCACAAGCCCAGCAACACCAAGGTG GACAAGAAAGTTGAGCCCAAATCTTGTG ACAAAACTCACACATGCCCACCGTGCCC AGCACCTGAACTCCTGGGGGGACCGTCA GTCTTCCTCTTCCCCCCAAAACCCAAGGA CACCCTCATGATCTCCCGGACCCCTGAG GTCACATGCGTGGTGGTGGACGTGAGCC ACGAAGACCCTGAGGTCAAGTTCAACTG GTACGTGGACGGCGTGGAGGTGCATAAT GCCAAGACAAAGCCGCGGGAGGAGCAG TACAACAGCACGTACCGTGTGGTCAGCG TCCTCACCGTCCTGCACCAGGACTGGCT GAATGGCAAGGAGTACAAGTGCAAGGTC TCCAACAAAGCCCTCCCAGCCCCCATCG AGAAAACCATCTCCAAAGCCAAAGGGCA GCCCCGAGAACCACAGGTGTACACCCTG CCCCCATCCCGGGATGAGCTGACCAAGA ACCAGGTCAGCCTGACCTGCCTGGTCAA AGGCTTCTATCCCAGCGACATCGCCGTG GAGTGGGAGAGCAATGGGCAGCCGGAG AACAACTACAAGACCACGCCTCCCGTGC TGGACTCCGACGGCTCCTTCTTCCTCTAC AGCAAGCTCACCGTGGACAAGAGCAGGT GGCAGCAGGGGAACGTCTTCTCATGCTC CGTGATGCATGAGGCTCTGCACAACCAC TACACGCAGAAGAGCCTCTCCCTGTCTC CGGGTAAATGA | 349 |

-continued

| DNA sequences | | |
|---|---|---|
| Light chain "CEA 2F1" | ATGGACATGAGGGTCCCCGCTCAGCTCC TGGGCCTCCTGCTGCTCTGGTTCCCAGGT GCCAGGTGTGATATCCAGATGACCCAGT CTCCATCCTCCCTGTCTGCATCTGTGGGA GACAGAGTCACCATCACTTGCAAGGCCA GTGCGGCTGTGGGTACGTATGTTGCGTG GTATCAGCAGAAACCAGGGAAAGCACCT AAGCTCCTGATCTATTCGGCATCCTACCG CAAAAGGGGAGTCCCATCAAGGTTCAGT GGCAGTGGATCTGGGACAGATTTCACTC TCACCATCAGCAGTCTGCAACCTGAAGA TTTCGCAACTTACTACTGTCACCAATATT ACACCTATCCTCTATTCACGTTTGGCCAG GGCACCAAGCTCGAGATCAAGCGTACGG TGGCTGCACCATCTGTCTTCATCTTCCCG CCATCTGATGAGCAGTTGAAATCTGGAA CTGCCTCTGTTGTGTGCCTGCTGAATAAC TTCTATCCCAGAGAGGCCAAAGTACAGT GGAAGGTGGATAACGCCCTCCAATCGGG TAACTCCCAGGAGAGTGTCACAGAGCAG GACAGCAAGGACAGCACCTACAGCCTCA GCAGCACCCTGACGCTGAGCAAAGCAGA CTACGAGAAACACAAAGTCTACGCCTGC GAAGTCACCCATCAGGGCCTGAGCTCGC CCGTCACAAAGAGCTTCAACAGGGGAGA GTGTTAG | 350 |
| VH "CEA CH1A1A 98-99" | ATGGGATGGAGCTGTATCATCCTCTTCTT GGTAGCAACAGCTACCGGTGTGCATTCC CAGGTGCAGCTGGTGCAGTCTGGCGCCG AAGTGAAGAAACCTGGAGCTAGTGTGAA GGTGTCCTGCAAGGCCAGCGGCTACACC TTCACCGAGTTCGGCATGAACTGGGTCC GACAGGCTCCAGGCCAGGGCCTCGAATG GATGGGCTGGATCAACACCAAGACCGGC GAGGCCACCTACGTGGAAGAGTTCAAGG GCAGAGTGACCTTCACCACGGACACCAG CACCAGCACCGCCTACATGGAACTGCGG AGCCTGAGAAGCGACGACACCGCCGTGT ACTACTGCGCCAGATGGGACTTCGCCTA TTACGTGGAAGCCATGGACTACTGGGGC CAGGGCACCACCGTGACCGTGTCTAGC | 351 |
| VH CDR H1 "CEA CH1A1A 98-99" | GAGTTCGGCATGAAC | 352 |
| VH CDR H2 "CEA CH1A1A 98-99" | TGGATCAACACCAAGACCGGCGAGGCCA CCTACGTGGAAGAGTTCAAGGGC | 353 |
| VH CDR H3 "CEA CH1A1A 98-99" | TGGGACTTCGCCTATTACGTGGAAGCCA TGGACTAC | 354 |
| VL "CEA 2F1" | GATATCCAGATGACCCAGTCTCCATCCTC CCTGTCTGCATCTGTGGGAGACAGAGTC ACCATCACTTGCAAGGCCAGTGCGGCTG TGGGTACGTATGTTGCGTGGTATCAGCA GAAACCAGGGAAAGCACCTAAGCTCCTG ATCTATTCGGCATCCTACCGCAAAAGGG GAGTCCCATCAAGGTTCAGTGGCAGTGG ATCTGGGACAGATTTCACTCTCACCATCA GCAGTCTGCAACCTGAAGATTTCGCAAC TTACTACTGTCACCAATATTACACCTATC CTCTATTCACGTTTGGCCAGGGCACCAA GCTCGAGATCAAG | 355 |
| VL CDR L1 "CEA 2F1" | AAGGCCAGTGCGGCTGTGGGTACGTATG TTGCG | 356 |
| VL CDR L2 "CEA 2F1" | TCGGCATCCTACCGCAAAAGG | 357 |
| VL CDR L3 "CEA 2F1" | CACCAATATTACACCTATCCTCTATTCAC G | 358 |

| DNA sequences | | |
|---|---|---|
| Exemplary MCSP_CD3 bispecific antibodies | | SEQ ID NO |
| Light chain ,,MCSP $_{ML2(G3)}$" | ATGGGATGGAGCTGTATCATCCTCTTCTT GGTAGCAACAGCTACCGGTGTGCATTCC GACATCCAGATGACCCAGAGCCCCAGCA GCCTGAGCGCCAGCGTGGGCGACAGAGT GACCATCACCTGCCGGGCCAGCCAGGGC ATCCGGAACTACCTGAACTGGTATCAGC AGAAGCCCGGCAAGGCCCCCAAGCTGCT GATCTACTACACCAGCAGCCTGCACAGC GGCGTGCCTAGCCGGTTTAGCGGCAGCG GCTCCGGCACCGACTACACCCTGACCATT AGCTCCCTGCAGCCCGAGGACTTCGCCA CCTACTACTGCCAGCAGTACTCTGCTCTG CCGTGGACCTTCGGCCAGGGAACAAAGG TGGAGATCAAGCGTACGGTGGCTGCACC ATCTGTCTTCATCTTCCCGCCATCTGATG AGCAGTTGAAATCTGGAACTGCCTCTGTT GTGTGCCTGCTGAATAACTTCTATCCCAG AGAGGCCAAAGTACAGTGGAAGGTGGAT AACGCCCTCCAATCGGGTAACTCCCAGG AGAGTGTCACAGAGCAGGACAGCAAGGA CAGCACCTACAGCCTCAGCAGCACCCTG ACGCTGAGCAAAGCAGACTACGAGAAAC ACAAAGTCTACGCCTGCGAAGTCACCCA TCAGGGCCTGAGCTCGCCCGTCACAAAG AGCTTCAACAGGGGAGAGTGTTAG | 340 |
| Light Chain humanized CD3 $_{CH2527}$ (Crossfab, VL-CH1) | ATGGGATGGAGCTGTATCATCCTCTTCTT GGTAGCAACAGCTACCGGTGTGCATTCTC AGGCCGTCGTGACCCAGGAACCCAGCCT GACAGTGTCTCCTGGCGGCACCGTGACC CTGACATGTGGCAGTTCTACAGGCGCCGT GACCACCAGCAACTACGCCAACTGGGTG CAGGAAAAGCCCGGCCAGGCCTTCAGAG GACTGATCGGCGGCACCAACAAGAGAGC CCCTGGCACCCCTGCCAGATTCAGCGGAT CTCTGCTGGGAGGAAAGGCCGCCCTGAC ACTGTCTGGCGCCCAGCCAGAAGATGAG GCCGAGTACTACTGCGCCCTGTGGTACAG CAACCTGTGGGTGTTCGGCGGAGGCACC AAGCTGACAGTGCTGAGCAGCGCTTCCA CCAAAGGCCCTTCCGTGTTTCCTCTGGCT CCTAGCTCCAAGTCCACCTCTGGAGGCAC CGCTGCTCTCGGATGCCTCGTGAAGGATT ATTTTCCTGAGCCTGTGACAGTGTCCTGG AATAGCGGAGCACTGACCTCTGGAGTGC ATACTTTCCCCGCTGTGCTGCAGTCCTCT GGACTGTACAGCCTGAGCAGCGTGGTGA CAGTGCCCAGCAGCAGCCTGGGCACCCA GACCTACATCTGCAACGTGAACCACAAG CCCAGCAACACCAAGGTGGACAAGAAGG TGGAACCCAAGTCTTGTTGA | 359 |
| MCSP $_{M4-3(C1)}$ (VH-CH1)-humanized CD3 $_{CH2527}$ (Crossfab VH-Ck)-Fc(knob) P329GLALA | ATGGGATGGAGCTGTATCATCCTCTTCTT GGTAGCAACAGCTACCGGTGTGCATTCCC AGGTGCAATTGCAGGAAAGCGGCCCTGG CCTGGTCAAGCCCAGCCAGACCCTGAGC CTGACCTGCACCGTGTCCGGCGGCAGCA TCACCAGCGGCTATTATTGGAACTGGATT CGGCAGCACCCCGGCAAGGGCCTGGAAT GGATCGGCTACATCACTTTCGACGGCTCT AACAACTACAACCCCAGCCTGAAGTCCA GAGTGACCATCAGCCGGGACACCAGCAA GAACCAGTTCAGCCTGAAGCTGTCCAGC GTGACAGCCGCCGACACCGCCGTGTACT ACTGCGCCGACTTCGACTACTGGGGCCA GGGCACCCTGGTCACCGTGTCCAGCGCT AGCACAAAGGGCCCCAGCGTGTTCCCTC TGGCCCCTAGCAGCAAGAGCACATCTGG CGGAACAGCCGCCCTGGGCTGCCTCGTG AAGGACTACTTTCCCGAGCCTGTGACCGT GTCCTGGAACTCTGGCGCCCTGACAAGC GGCGTGCACACCTTTCCAGCCGTGCTGCA GAGCAGCGGCCTGTACTCTCTGAGCAGC GTGGTCACCGTGCCTAGCAGCAGCCTGG GCACCCAGACCTACATCTGCAACGTGAA | 360 |

| DNA sequences | |
|---|---|
| | CCACAAGCCCAGCAACACCAAAGTGGAC
AAGAAGGTGGAGCCCAAGAGCTGTGATG
GCGGAGGAGGGTCCGGAGGCGGAGGATC
CGAGGTGCAGCTGCTGGAATCTGGCGGC
GGACTGGTGCAGCCTGGCGGATCTCTGA
GACTGAGCTGTGCCGCCAGCGGCTTCAC
CTTCAGCACCTACGCCATGAACTGGGTGC
GCCAGGCCCCTGGCAAAGGCCTGGAATG
GGTGTCCCGGATCAGAAGCAAGTACAAC
AACTACGCCACCTACTACGCCGACAGCG
TGAAGGGCCGGTTCACCATCAGCCGGGA
CGACAGCAAGAACACCCTGTACCTGCAG
ATGAACAGCCTGCGGGCCGAGGACACCG
CCGTGTACTATTGTGTGCGGCACGGCAAC
TTCGGCAACAGCTATGTGTCTTGGTTTGC
CTACTGGGGCCAGGGCACCCTCGTGACC
GTGTCAAGCGCTAGCGTGGCCGCTCCCTC
CGTGTTTATCTTTCCCCCATCCGATGAAC
AGCTGAAAAGCGGCACCGCCTCCGTCGT
GTGTCTGCTGAACAATTTTTACCCTAGGG
AAGCTAAAGTGCAGTGGAAAGTGGATAA
CGCACTGCAGTCCGGCAACTCCCAGGAA
TCTGTGACAGAACAGGACTCCAAGGACA
GCACCTACTCCCTGTCCTCCACCCTGACA
CTGTCTAAGGCTGATTATGAGAAACACA
AAGTCTACGCCTGCGAAGTCACCCATCA
GGGCCTGAGCTCGCCCGTCACAAAGAGC
TTCAACAGGGGAGAGTGTGACAAGACCC
ACACCTGTCCCCCTTGTCCTGCCCCTGAA
GCTGCTGGCGGCCCTTCTGTGTTCCTGTT
CCCCCCAAAGCCCAAGGACACCCTGATG
ATCAGCCGGACCCCCGAAGTGACCTGCG
TGGTGGTGGATGTGTCCCACGAGGACCCT
GAAGTGAAGTTCAATTGGTACGTGGACG
GCGTGGAAGTGCACAACGCCAAGACAAA
GCCGCGGGAGGAGCAGTACAACAGCACG
TACCGTGTGGTCAGCGTCCTCACCGTCCT
GCACCAGGACTGGCTGAATGGCAAGGAG
TACAAGTGCAAGGTCTCCAACAAAGCCC
TCGGCGCCCCCATCGAGAAAACCATCTC
CAAAGCCAAAGGGCAGCCCCGAGAACCA
CAGGTGTACACCCTGCCCCCATGCCGGG
ATGAGCTGACCAAGAACCAGGTCAGCCT
GTGGTGCCTGGTCAAAGGCTTCTATCCCA
GCGACATCGCCGTGGAGTGGGAGAGCAA
TGGGCAGCCGGAGAACAACTACAAGACC
ACGCCTCCCGTGCTGGACTCCGACGGCTC
CTTCTTCCTCTACAGCAAGCTCACCGTGG
ACAAGAGCAGGTGGCAGCAGGGGAACGT
CTTCTCATGCTCCGTGATGCATGAGGCTC
TGCACAACCACTACACGCAGAAGAGCCT
CTCCCTGTCTCCGGGTAAATGA | |
| MCSP $_{M4-3(C1)}$ (VH-CH1) Fc(hole) P329GLALA | ATGGGCTGGTCCTGCATCATCCTGTTTCT
GGTGGCTACCGCCACTGGAGTGCATTCCC
AGGTGCAATTGCAGGAAAGCGGCCCTGG
CCTGGTCAAGCCCAGCCAGACCCTGAGC
CTGACCTGCACCGTGTCCGGCGGCAGCA
TCACCAGCGGCTATTATTGGAACTGGATT
CGGCAGCACCCCGGCAAGGGCCTGGAAT
GGATCGGCTACATCACTTTCGACGGCTCT
AACAACTACAACCCCAGCCTGAAGTCCA
GAGTGACCATCAGCCGGGACACCAGCAA
GAACCAGTTCAGCCTGAAGCTGTCCAGC
GTGACAGCCGCCGACACCGCCGTGTACT
ACTGCGCCGACTTCGACTACTGGGGCCA
GGGCACCCTGGTCACCGTGTCCAGCGCT
AGCACCAAGGGCCCCTCCGTGTTCCCCCT
GGCCCCCAGCAGCAAGAGCACCAGCGGC
GGCACAGCCGCTCTGGGCTGCCTGGTCA
AGGACTACTTCCCCGAGCCCGTGACCGT
GTCCTGGAACAGCGGAGCCCTGACCTCC
GGCGTGCACACCTTCCCCGCCGTGCTGCA
GAGTTCTGGCCTGTATAGCCTGAGCAGCG
TGGTCACCGTGCCTTCTAGCAGCCTGGGC
ACCCAGACCTACATCTGCAACGTGAACC
ACAAGCCCAGCAACACCAAGGTGGACAA | 361 |

| DNA sequences | |
|---|---|
| | GAAGGTGGAGCCCAAGAGCTGCGACAAA<br>ACTCACACATGCCCACCGTGCCCAGCAC<br>CTGAAGCTGCAGGGGGACCGTCAGTCTT<br>CCTCTTCCCCCCAAAACCCAAGGACACCC<br>TCATGATCTCCCGGACCCCTGAGGTCACA<br>TGCGTGGTGGTGGACGTGAGCCACGAAG<br>ACCCTGAGGTCAAGTTCAACTGGTACGTG<br>GACGGCGTGGAGGTGCATAATGCCAAGA<br>CAAAGCCGCGGGAGGAGCAGTACAACAG<br>CACGTACCGTGTGGTCAGCGTCCTCACCG<br>TCCTGCACCAGGACTGGCTGAATGGCAA<br>GGAGTACAAGTGCAAGGTCTCCAACAAA<br>GCCCTCGGCGCCCCCATCGAGAAAACCA<br>TCTCCAAAGCCAAAGGGCAGCCCCGAGA<br>ACCACAGGTGTGCACCCTGCCCCCATCCC<br>GGGATGAGCTGACCAAGAACCAGGTCAG<br>CCTCTCGTGCGCAGTCAAAGGCTTCTATC<br>CCAGCGACATCGCCGTGGAGTGGGAGAG<br>CAATGGGCAGCCGGAGAACAACTACAAG<br>ACCACGCCTCCCGTGCTGGACTCCGACG<br>GCTCCTTCTTCCTCGTGAGCAAGCTCACC<br>GTGGACAAGAGCAGGTGGCAGCAGGGGA<br>ACGTCTTCTCATGCTCCGTGATGCATGAG<br>GCTCTGCACAACCACTACACGCAGAAGA<br>GCCTCTCCCTGTCTCCGGGTAAATGA |
| Light Chain humanized<br>CD3 $_{CH2527}$ (Crossfab,<br>VL-CH1) | ATGGGATGGAGCTGTATCATCCTCTTCTT<br>GGTAGCAACAGCTACCGGTGTGCATTCTC<br>AGGCCGTCGTGACCCAGGAACCCAGCCT<br>GACAGTGTCTCCTGGCGGCACCGTGACC<br>CTGACATGTGGCAGTTCTACAGGCGCCGT<br>GACCACCAGCAACTACGCCAACTGGGTG<br>CAGGAAAAGCCCGGCCAGGCCTTCAGAG<br>GACTGATCGGCGGCACCAACAAGAGAGC<br>CCCTGGCACCCCTGCCAGATTCAGCGGAT<br>CTCTGCTGGGAGGAAAGGCCGCCCTGAC<br>ACTGTCTGGCGCCCAGCCAGAAGATGAG<br>GCCGAGTACTACTGCGCCCTGTGGTACAG<br>CAACCTGTGGGTGTTCGGCGGAGGCACC<br>AAGCTGACAGTGCTGAGCAGCGCTTCCA<br>CCAAAGGCCCTTCCGTGTTTCCTCTGGCT<br>CCTAGCTCCAAGTCCACCTCTGGAGGCAC<br>CGCTGCTCTCGGATGCCTCGTGAAGGATT<br>ATTTTCCTGAGCCTGTGACAGTGTCCTGG<br>AATAGCGGAGCACTGACCTCTGGAGTGC<br>ATACTTTCCCCGCTGTGCTGCAGTCCTCT<br>GGACTGTACAGCCTGAGCAGCGTGGTGA<br>CAGTGCCCAGCAGCAGCCTGGGCACCCA<br>GACCTACATCTGCAACGTGAACCACAAG<br>CCCAGCAACACCAAGGTGGACAAGAAGG<br>TGGAACCCAAGTCTTGTTGA | 379 |
| aVH $_{(MCSP)}$-humanized<br>CD3 $_{CH2527}$ (VH-CK)-<br>Fc(knob) P329GLALA | ATGGGATGGAGCTGTATCATCCTCTTCTT<br>GGTAGCAACAGCTACCGGTGTGCATTCC<br>GAAGTTCAGCTGGTTGAAAGCGGTGGTG<br>GTCTGGTTCAGCCTGGTGGTAGCCTGCGT<br>CTGAGCTGTGCAGCAAGCGGTTTTAATAT<br>CAAAGATACCTATATTGGTTGGGTTCGTC<br>GTGCACCGGGTAAAGGTACCGAACTGGT<br>TGCACGTATTTATCCGACCAATGGTTATA<br>CCCGTTATGCAGATAGCGTGAAAGGTCG<br>TTTTACCATTAGCGCAGATACCAGCAAAA<br>ATACCGCATATCTGCAGATGAATAGCCTG<br>CGTGCCGAGGACACGGCCGTATATTACT<br>GTGCGCGTACTTCTTGGGGTGGTTGGCTG<br>TCTGGTGACTACTGGGGCCAAGGAACCC<br>TGGTTACTGTCTCGAGTGGCGGAGGAGG<br>GTCCGGAGGCGGAGGATCCGAGGTGCAG<br>CTGCTGGAATCTGGCGGCGGACTGGTGC<br>AGCCTGGCGGATCTCTGAGACTGAGCTGT<br>GCCGCCAGCGGCTTCACCTTCAGCACCTA<br>CGCCATGAACTGGGTGCGCCAGGCCCCT<br>GGCAAGGCCTGGAATGGGTGTCCCGGA<br>TCAGAAGCAAGTACAACAACTACGCCAC<br>CTACTACGCCGACAGCGTGAAGGGCCGG<br>TTCACCATCAGCCGGGACGACAGCAAGA<br>ACACCCTGTACCTGCAGATGAACAGCCT | 380 |

| DNA sequences | |
|---|---|
| | GCGGGCCGAGGACACCGCCGTGTACTAT
TGTGTGCGGCACGGCAACTTCGGCAACA
GCTATGTGTCTTGGTTTGCCTACTGGGGC
CAGGGCACCCTCGTGACCGTGTCAAGCG
CTAGCGTGGCCGCTCCCTCCGTGTTTATC
TTTCCCCCATCCGATGAACAGCTGAAAAG
CGGCACCGCCTCCGTCGTGTGTCTGCTGA
ACAATTTTTACCCTAGGGAAGCTAAAGTG
CAGTGGAAAGTGGATAACGCACTGCAGT
CCGGCAACTCCCAGGAATCTGTGACAGA
ACAGGACTCCAAGGACAGCACCTACTCC
CTGTCCTCCACCCTGACACTGTCTAAGGC
TGATTATGAGAAACACAAAGTCTACGCC
TGCGAAGTCACCCATCAGGGCCTGAGCT
CGCCCGTCACAAAGAGCTTCAACAGGGG
AGAGTGTGACAAGACCCACACCTGTCCC
CCTTGTCCTGCCCCTGAAGCTGCTGGCGG
CCCTTCTGTGTTCCTGTTCCCCCCAAAGC
CCAAGGACACCCTGATGATCAGCCGGAC
CCCCGAAGTGACCTGCGTGGTGGTGGAT
GTGTCCCACGAGGACCCTGAAGTGAAGT
TCAATTGGTACGTGGACGGCGTGGAAGT
GCACAACGCCAAGACAAAGCCGCGGGAG
GAGCAGTACAACAGCACGTACCGTGTGG
TCAGCGTCCTCACCGTCCTGCACCAGGAC
TGGCTGAATGGCAAGGAGTACAAGTGCA
AGGTCTCCAACAAAGCCCTCGGCGCCCC
CATCGAGAAACCATCTCCAAAGCCAAA
GGGCAGCCCCGAGAACCACAGGTGTACA
CCCTGCCCCCATGCCGGGATGAGCTGAC
CAAGAACCAGGTCAGCCTGTGGTGCCTG
GTCAAAGGCTTCTATCCCAGCGACATCGC
CGTGGAGTGGGAGAGCAATGGGCAGCCG
GAGAACAACTACAAGACCACGCCTCCCG
TGCTGGACTCCGACGGCTCCTTCTTCCTC
TACAGCAAGCTCACCGTGGACAAGAGCA
GGTGGCAGCAGGGGAACGTCTTCTCATG
CTCCGTGATGCATGAGGCTCTGCACAACC
ACTACACGCAGAAGAGCCTCTCCCTGTCT
CCGGGTAAATGA | |
| aVH (MCSP)-Fc(hole) P329GLALA | ATGGGCTGGTCCTGCATCATCCTGTTTCT
GGTGGCTACCGCCACTGGAGTGCATTCCG
AAGTTCAGCTGGTTGAAAGCGGTGGTGG
TCTGGTTCAGCCTGGTGGTAGCCTGCGTC
TGAGCTGTGCAGCAAGCGGTTTTAATATC
AAAGATACCTATATTGGTTGGGTTCGTCG
TGCACCGGGTAAAGGTACCGAACTGGTT
GCACGTATTTATCCGACCAATGGTTATAC
CCGTTATGCAGATAGCGTGAAAGGTCGTT
TTACCATTAGCGCAGATACCAGCAAAAA
TACCGCATATCTGCAGATGAATAGCCTGC
GTGCCGAGGACACGGCCGTATATTACTGT
GCGCGTACTTCTTGGGGTGGTTGGCTGTC
TGGTGACTACTGGGGCCAAGGAACCCTG
GTTACTGTCTCGAGTGACAAAACTCACAC
ATGCCCACCGTGCCCAGCACCTGAAGCT
GCAGGGGGACCGTCAGTCTTCCTCTTCCC
CCCAAAACCCAAGGACACCCTCATGATC
TCCCGGACCCCTGAGGTCACATGCGTGGT
GGTGGACGTGAGCCACGAAGACCCTGAG
GTCAAGTTCAACTGGTACGTGGACGGCG
TGGAGGTGCATAATGCCAAGACAAAGCC
GCGGGAGGAGCAGTACAACAGCACGTAC
CGTGTGGTCAGCGTCCTCACCGTCCTGCA
CCAGGACTGGCTGAATGGCAAGGAGTAC
AAGTGCAAGGTCTCCAACAAAGCCCTCG
GCGCCCCCATCGAGAAAACCATCTCCAA
AGCCAAAGGGCAGCCCCGAGAACCACAG
GTGTGCACCCTGCCCCCATCCCGGGATGA
GCTGACCAAGAACCAGGTCAGCCTCTCG
TGCGCAGTCAAAGGCTTCTATCCCAGCGA
CATCGCCGTGGAGTGGGAGAGCAATGGG
CAGCCGGAGAACAACTACAAGACCACGC
CTCCCGTGCTGGACTCCGACGGCTCCTTC
TTCCTCGTGAGCAAGCTCACCGTGGACAA
GAGCAGGTGGCAGCAGGGGAACGTCTTC | 381 |

-continued

| | DNA sequences | |
|---|---|---|
| | TCATGCTCCGTGATGCATGAGGCTCTGCA<br>CAACCACTACACGCAGAAGAGCCTCTCC<br>CTGTCTCCGGGTAAATGA | |
| Light chain<br>,,MCSP $_{ML2\ (G3)}$" | ATGGGATGGAGCTGTATCATCCTCTTCTT<br>GGTAGCAACAGCTACCGGTGTGCATTCC<br>GACATCCAGATGACCCAGAGCCCCAGCA<br>GCCTGAGCGCCAGCGTGGGCGACAGAGT<br>GACCATCACCTGCCGGGCCAGCCAGGGC<br>ATCCGGAACTACCTGAACTGGTATCAGC<br>AGAAGCCCGGCAAGGCCCCCAAGCTGCT<br>GATCTACTACACCAGCAGCCTGCACAGC<br>GGCGTGCCTAGCCGGTTTAGCGGCAGCG<br>GCTCCGGCACCGACTACACCCTGACCATT<br>AGCTCCCTGCAGCCCGAGGACTTCGCCA<br>CCTACTACTGCCAGCAGTACTCTGCTCTG<br>CCGTGGACCTTCGGCCAGGGAACAAAGG<br>TGGAGATCAAGCGTACGGTGGCTGCACC<br>ATCTGTCTTCATCTTCCCGCCATCTGATG<br>AGCAGTTGAAATCTGGAACTGCCTCTGTT<br>GTGTGCCTGCTGAATAACTTCTATCCCAG<br>AGAGGCCAAAGTACAGTGGAAGGTGGAT<br>AACGCCCTCCAATCGGGTAACTCCCAGG<br>AGAGTGTCACAGAGCAGGACAGCAAGGA<br>CAGCACCTACAGCCTCAGCAGCACCCTG<br>ACGCTGAGCAAAGCAGACTACGAGAAAC<br>ACAAAGTCTACGCCTGCGAAGTCACCCA<br>TCAGGGCCTGAGCTCGCCCGTCACAAAG<br>AGCTTCAACAGGGGAGAGTGTTAG | 382 |
| Light Chain humanized<br>CD3 $_{CH2527}$ (Crossfab, VL-<br>CH1) | ATGGGATGGAGCTGTATCATCCTCTTCTT<br>GGTAGCAACAGCTACCGGTGTGCATTCTC<br>AGGCCGTCGTGACCCAGGAACCCAGCCT<br>GACAGTGTCTCCTGGCGGCACCGTGACC<br>CTGACATGTGGCAGTTCTACAGGCGCCGT<br>GACCACCAGCAACTACGCCAACTGGGTG<br>CAGGAAAAGCCCGGCCAGGCCTTCAGAG<br>GACTGATCGGCGGCACCAACAAGAGAGC<br>CCCTGGCACCCCTGCCAGATTCAGCGGAT<br>CTCTGCTGGGAGGAAAGGCCGCCCTGAC<br>ACTGTCTGGCGCCCAGCCAGAAGATGAG<br>GCCGAGTACTACTGCGCCCTGTGGTACAG<br>CAACCTGTGGGTGTTCGGCGGAGGCACC<br>AAGCTGACAGTGCTGAGCAGCGCTTCCA<br>CCAAAGGCCCTTCCGTGTTTCCTCTGGCT<br>CCTAGCTCCAAGTCCACCTCTGGAGGCAC<br>CGCTGCTCTCGGATGCCTCGTGAAGGATT<br>ATTTTCCTGAGCCTGTGACAGTGTCCTGG<br>AATAGCGGAGCACTGACCTCTGGAGTGC<br>ATACTTTCCCCGCTGTGCTGCAGTCCTCT<br>GGACTGTACAGCCTGAGCAGCGTGGTGA<br>CAGTGCCCAGCAGCAGCCTGGGCACCCA<br>GACCTACATCTGCAACGTGAACCACAAG<br>CCCAGCAACACCAAGGTGGACAAGAAGG<br>TGGAACCCAAGTCTTGTTGA | 383 |
| MCSP $_{M4-3(C1)}$-<br>humanized CD3 $_{CH2527}$<br>(VH-CK)-Fc(DD)<br>P329GLALA | ATGGGATGGAGCTGTATCATCCTCTTCTT<br>GGTAGCAACAGCTACCGGTGTGCATTCCC<br>AGGTGCAATTGCAGGAAAGCGGCCCTGG<br>CCTGGTCAAGCCCAGCCAGACCCTGAGC<br>CTGACCTGCACCGTGTCCGGCGGCAGCA<br>TCACCAGCGGCTATTATTGGAACTGGATT<br>CGGCAGCACCCCGGCAAGGGCCTGGAAT<br>GGATCGGCTACATCACTTTCGACGGCTCT<br>AACAACTACAACCCCAGCCTGAAGTCCA<br>GAGTGACCATCAGCCGGGACACCAGCAA<br>GAACCAGTTCAGCCTGAAGCTGTCCAGC<br>GTGACAGCCGCCGACACCGCCGTGTACT<br>ACTGCGCCGACTTCGACTACTGGGGCCA<br>GGGCACCCTGGTCACCGTGTCCAGCGCT<br>AGCACAAAGGGCCCCAGCGTGTTCCCTC<br>TGGCCCCTAGCAGCAAGAGCACATCTGG<br>CGGAACAGCCGCCCTGGGCTGCCTCGTG<br>AAGGACTACTTTCCCGAGCCTGTGACCGT<br>GTCCTGGAACTCTGGCGCCCTGACAAGC<br>GGCGTGCACACCTTTCCAGCCGTGCTGCA<br>GAGCAGCGGCCTGTACTCTCTGAGCAGC | 384 |

-continued

| | DNA sequences | |
|---|---|---|
| | GTGGTCACCGTGCCTAGCAGCAGCCTGG<br>GCACCCAGACCTACATCTGCAACGTGAA<br>CCACAAGCCCAGCAACACCAAAGTGGAC<br>AAGAAGGTGGAGCCCAAGAGCTGTGATG<br>GCGGAGGAGGGTCCGGAGGCGGAGGATC<br>CGAGGTGCAGCTGCTGGAATCTGGCGGC<br>GGACTGGTGCAGCCTGGCGGATCTCTGA<br>GACTGAGCTGTGCCGCCAGCGGCTTCAC<br>CTTCAGCACCTACGCCATGAACTGGGTGC<br>GCCAGGCCCCTGGCAAAGGCCTGGAATG<br>GGTGTCCCGGATCAGAAGCAAGTACAAC<br>AACTACGCCACCTACTACGCCGACAGCG<br>TGAAGGGCCGGTTCACCATCAGCCGGGA<br>CGACAGCAAGAACACCCTGTACCTGCAG<br>ATGAACAGCCTGCGGGCCGAGGACACCG<br>CCGTGTACTATTGTGTGCGGCACGGCAAC<br>TTCGGCAACAGCTATGTGTCTTGGTTTGC<br>CTACTGGGGCCAGGGCACCCTCGTGACC<br>GTGTCAAGCGCTAGCGTGGCCGCTCCCTC<br>CGTGTTTATCTTTCCCCCATCCGATGAAC<br>AGCTGAAAAGCGGCACCGCCTCCGTCGT<br>GTGTCTGCTGAACAATTTTTACCCTAGGG<br>AAGCTAAAGTGCAGTGGAAAGTGGATAA<br>CGCACTGCAGTCCGGCAACTCCCAGGAA<br>TCTGTGACAGAACAGGACTCCAAGGACA<br>GCACCTACTCCCTGTCCTCCACCCTGACA<br>CTGTCTAAGGCTGATTATGAGAAACACA<br>AAGTCTACGCCTGCGAAGTCACCCATCA<br>GGGCCTGAGCTCGCCCGTCACAAAGAGC<br>TTCAACAGGGGAGAGTGTGACAAGACCC<br>ACACCTGTCCCCCTTGTCCTGCCCCTGAA<br>GCTGCTGGCGGCCCTTCTGTGTTCCTGTT<br>CCCCCCAAAGCCCAAGGACACCCTGATG<br>ATCAGCCGGACCCCCGAAGTGACCTGCG<br>TGGTGGTGGATGTGTCCCACGAGGACCCT<br>GAAGTGAAGTTCAATTGGTACGTGGACG<br>GCGTGGAAGTGCACAACGCCAAGACAAA<br>GCCGCGGGAGGAGCAGTACAACAGCACG<br>TACCGTGTGGTCAGCGTCCTCACCGTCCT<br>GCACCAGGACTGGCTGAATGGCAAGGAG<br>TACAAGTGCAAGGTCTCCAACAAAGCCC<br>TCGGCGCCCCCATCGAGAAAACCATCTC<br>CAAAGCCAAAGGGCAGCCCCGAGAACCA<br>CAGGTGTACACCCTGCCCCCATCCCGGG<br>ATGAGCTGACCAAGAACCAGGTCAGCCT<br>GACCTGCCTGGTCAAAGGCTTCTATCCCA<br>GCGACATCGCCGTGGAGTGGGAGAGCAA<br>TGGGCAGCCGGAGAACAACTACGACACC<br>ACGCCTCCCGTGCTGGACTCCGACGGCTC<br>CTTCTTCCTCTACAGCGACCTCACCGTGG<br>ACAAGAGCAGGTGGCAGCAGGGGAACGT<br>CTTCTCATGCTCCGTGATGCATGAGGCTC<br>TGCACAACCACTACACGCAGAAGAGCCT<br>CTCCCTGTCTCCGGGTAAATGA | |
| MCSP $_{M4-3(C1)}$-Fc(KK)<br>P329GLALA | ATGGGCTGGTCCTGCATCATCCTGTTTCT<br>GGTGGCTACCGCCACTGGAGTGCATTCCC<br>AGGTGCAGCTGCAGGAAAGCGGCCCTGG<br>CCTGGTCAAGCCCAGCCAGACCCTGAGC<br>CTGACCTGCACCGTGTCCGGCGGCAGCA<br>TCACCAGCGGCTACTACTGGAACTGGATC<br>CGGCAGCACCCCGGCAAGGGCCTGGAAT<br>GGATCGGCTACATCACCTACGACGGCAG<br>CAACAACTACAACCCCAGCCTGAAGTCC<br>AGAGTGACCATCAGCCGGGACACCAGCA<br>AGAACCAGTTCAGCCTGAAGCTGTCCAG<br>CGTGACAGCCGCCGACACCGCCGTGTAC<br>TACTGCGCCGACTTCGACTACTGGGGCCA<br>GGGCACCCTGGTCACCGTGTCCAGCGCT<br>AGCACCAAGGGCCCATCGGTCTTCCCCCT<br>GGCCCCTCCTCCAAGAGCACCTCTGGG<br>GGCACAGCGGCCCTGGGCTGCCTGGTCA<br>AGGACTACTTCCCCGAACCGGTGACGGT<br>GTCGTGGAACTCAGGCGCCCTGACCAGC<br>GGCGTGCACACCTTCCCGGCTGTCCTACA<br>GTCCTCAGGACTCTACTCCCTCAGCAGCG<br>TGGTGACCGTGCCCTCCAGCAGCTTGGGC | 385 |

| DNA sequences | |
|---|---|
| | ACCCAGACCTACATCTGCAACGTGAATC
ACAAGCCCAGCAACACCAAGGTGGACAA
GAAAGTTGAGCCCAAATCTTGTGACAAA
ACTCACACATGCCCACCGTGCCCAGCAC
CTGAAGCTGCAGGGGGACCGTCAGTCTT
CCTCTTCCCCCCAAAACCCAAGGACACCC
TCATGATCTCCCGGACCCCTGAGGTCACA
TGCGTGGTGGTGGACGTGAGCCACGAAG
ACCCTGAGGTCAAGTTCAACTGGTACGTG
GACGGCGTGGAGGTGCATAATGCCAAGA
CAAAGCCGCGGGAGGAGCAGTACAACAG
CACGTACCGTGTGGTCAGCGTCCTCACCG
TCCTGCACCAGGACTGGCTGAATGGCAA
GGAGTACAAGTGCAAGGTCTCCAACAAA
GCCCTCGGCGCCCCCATCGAGAAAACCA
TCTCCAAAGCCAAAGGGCAGCCCCGAGA
ACCACAGGTGTACACCCTGCCCCCATCCC
GGGAAAGAGCTGACCAAGAACCAGGTCAG
CCTGACCTGCCTGGTCAAAGGCTTCTATC
CCAGCGACATCGCCGTGGAGTGGGAGAG
CAATGGGCAGCCGGAGAACAACTACAAG
ACCACGCCTCCCGTGCTGAAGTCCGACG
GCTCCTTCTTCCTCTACAGCAAGCTCACC
GTGGACAAGAGCAGGTGGCAGCAGGGGA
ACGTCTTCTCATGCTCCGTGATGCATGAG
GCTCTGCACAACCACTACACGCAGAAGA
GCCTCTCCCTGTCTCCGGGTAAATGA |

| Exemplary CEA_CD3 bispecific antibody | | SEQ ID NO. |
|---|---|---|
| Light chain ,,CEA $_{2F1}$" | ATGGACATGAGGGTCCCCGCTCAGCTCCTGG
GCCTCCTGCTGCTCTGGTTCCCAGGTGCCAG
GTGTGATATCCAGATGACCCAGTCTCCATCC
TCCCTGTCTGCATCTGTGGGAGACAGAGTCA
CCATCACTTGCAAGGCCAGTGCGGCTGTGGG
TACGTATGTTGCGTGGTATCAGCAGAAACCA
GGGAAAGCACCTAAGCTCCTGATCTATTCGG
CATCCTACCGCAAAGGGGAGTCCCATCAAG
GTTCAGTGGCAGTGGATCTGGGACAGATTTC
ACTCTCACCATCAGCAGTCTGCAACCTGAAG
ATTTCGCAACTTACTACTGTCACCAATATTAC
ACCTATCCTCTATTCACGTTTGGCCAGGGCA
CCAAGCTCGAGATCAAGCGTACGGTGGCTGC
ACCATCTGTCTTCATCTTCCCGCCATCTGATG
AGCAGTTGAAATCTGGAACTGCCTCTGTTGT
GTGCCTGCTGAATAACTTCTATCCCAGAGAG
GCCAAAGTACAGTGGAAGGTGGATAACGCC
CTCCAATCGGGTAACTCCCAGGAGAGTGTCA
CAGAGCAGGACAGCAAGGACAGCACCTACA
GCCTCAGCAGCACCCTGACGCTGAGCAAAGC
AGACTACGAGAAACACAAAGTCTACGCCTGC
GAAGTCACCCATCAGGGCCTGAGCTCGCCCG
TCACAAAGAGCTTCAACAGGGGAGAGTGTTA
G | 350 |
| Light Chain humanized CD3 $_{CH2527}$ (Crossfab, VL-CH1) | ATGGGATGGAGCTGTATCATCCTCTTCTTGGT
AGCAACAGCTACCGGTGTGCATTCTCAGGCC
GTCGTGACCCAGGAACCCAGCCTGACAGTGT
CTCCTGGCGGCACCGTGACCCTGACATGTGG
CAGTTCTACAGGCGCCGTGACCACCAGCAAC
TACGCCAACTGGGTGCAGGAAAAGCCCGGC
CAGGCCTTCAGAGGACTGATCGGCGGCACCA
ACAAGAGAGCCCCTGGCACCCCTGCCAGATT
CAGCGGATCTCTGCTGGGAGGAAAGGCCGCC
CTGACACTGTCTGGCGCCCAGCCAGAAGATG
AGGCCGAGTACTACTGCGCCCTGTGGTACAG
CAACCTGTGGGTGTTCGGCGGAGGCACCAAG
CTGACAGTGCTGAGCAGCGCTTCCACCAAAG
GCCCTTCCGTGTTTCCTCTGGCTCCTAGCTCC
AAGTCCACCTCTGGAGGCACCGCTGCTCTCG
GATGCCTCGTGAAGGATTATTTTCCTGAGCC
TGTGACAGTGTCCTGGAATAGCGGAGCACTG
ACCTCTGGAGTGCATACTTTCCCCGCTGTGCT
GCAGTCCTCTGGACTGTACAGCCTGAGCAGC
GTGGTGACAGTGCCCAGCAGCAGCCTGGGCA | 362 |

| DNA sequences | |
|---|---|
| | CCCAGACCTACATCTGCAACGTGAACCACAA<br>GCCCAGCAACACCAAGGTGGACAAGAAGGT<br>GGAACCCAAGTCTTGTTGA | |
| CEA $_{CH1A1A\ 98/99}$-humanized CD3 $_{CH2527}$ (Crossfab VH-Ck)-Fc(knob) P329GLALA | ATGGGATGGAGCTGTATCATCCTCTTCTTGGT<br>AGCAACAGCTACCGGTGTGCATTCCCAGGTG<br>CAGCTGGTGCAGTCTGGCGCCGAAGTGAAGA<br>AACCTGGCGCCAGCGTGAAGGTGTCCTGCAA<br>GGCCAGCGGCTACACCTTCACCGAGTTCGGC<br>ATGAACTGGGTCCGACAGGCCCCTGGACAGG<br>GCCTGGAATGGATGGGCTGGATCAACACCAA<br>GACCGGCGAGGCCACCTACGTGGAAGAGTTC<br>AAGGGCAGAGTGACCTTCACCACCGACACCA<br>GCACCAGCACCGCCTACATGGAACTGCGGAG<br>CCTGAGAAGCGACGACACCGCCGTGTACTAC<br>TGCGCCAGATGGGACTTCGCCTACTATGTGG<br>AAGCCATGGACTACTGGGGCCAGGGCACCA<br>CCGTGACCGTGTCTAGTGCTAGCACAAAGGG<br>CCCCAGCGTGTTCCCTCTGGCCCCTAGCAGC<br>AAGAGCACATCTGGCGGAACAGCCGCCCTG<br>GGCTGCCTGGTCAAGGACTACTTTCCCGAGC<br>CCGTGACAGTGTCCTGGAACTCTGGCGCCCT<br>GACAAGCGGCGTGCACACCTTTCCAGCCGTG<br>CTGCAGAGCAGCGGCCTGTACTCTCTGAGCA<br>GCGTGGTCACCGTGCCTAGCTCTAGCCTGGG<br>CACCCAGACCTACATCTGCAACGTGAACCAC<br>AAGCCCAGCAACACCAAGGTGGACAAGAAG<br>GTGGAACCCAAGAGCTGCGATGGCGGAGGC<br>GGCTCCGGAGGCGGAGGATCCGAGGTGCAG<br>CTGCTGGAATCTGGCGGCGGACTGGTGCAGC<br>CTGGCGGATCTCTGAGACTGAGCTGTGCCGC<br>CAGCGGCTTCACCTTCAGCACCTACGCCATG<br>AACTGGGTGCGCCAGGCCCCTGGCAAAGGCC<br>TGGAATGGGTGTCCCGGATCAGAAGCAAGTA<br>CAACAACTACGCCACCTACTACGCCGACAGC<br>GTGAAGGGCCGGTTCACCATCAGCCGGGACG<br>ACAGCAAGAACACCCTGTACCTGCAGATGAA<br>CAGCCTGCGGGCCGAGGACACCGCCGTGTAC<br>TATTGTGTGCGGCACGGCAACTTCGGCAACA<br>GCTATGTGTCTTGGTTTGCCTACTGGGGCCA<br>GGGCACCCTCGTGACCGTGTCAAGCGCTAGC<br>GTGGCCGCTCCCTCCGTGTTTATCTTTCCCCC<br>ATCCGATGAACAGCTGAAAAGCGGCACCGC<br>CTCCGTCGTGTGTCTGCTGAACAATTTTTACC<br>CTAGGGAAGCTAAAGTGCAGTGGAAAGTGG<br>ATAACGCACTGCAGTCCGGCAACTCCCAGGA<br>ATCTGTGACAGAACAGGACTCCAAGGACAG<br>CACCTACTCCCTGTCCTCCACCCTGACACTGT<br>CTAAGGCTGATTATGAGAAACACAAAGTCTA<br>CGCCTGCGAAGTCACCCATCAGGGCCTGAGC<br>TCGCCCGTCACAAAGAGCTTCAACAGGGGAG<br>AGTGTGACAAGACCCACACCTGTCCCCCTTG<br>TCCTGCCCCTGAAGCTGCTGGCGGCCCTTCT<br>GTGTTCCTGTTCCCCCCAAAGCCCAAGGACA<br>CCCTGATGATCAGCCGGACCCCCGAAGTGAC<br>CTGCGTGGTGGTGGATGTGTCCCACGAGGAC<br>CCTGAAGTGAAGTTCAATTGGTACGTGGACG<br>GCGTGGAAGTGCACAACGCCAAGACAAAGC<br>CGCGGGAGGAGCAGTACAACAGCACGTACC<br>GTGTGGTCAGCGTCCTCACCGTCCTGCACCA<br>GGACTGGCTGAATGGCAAGGAGTACAAGTG<br>CAAGGTCTCCAACAAAGCCCTCGGCGCCCCC<br>ATCGAGAAAACCATCTCCAAAGCCAAAGGG<br>CAGCCCCGAGAACCACAGGTGTACACCCTGC<br>CCCCATGCCGGGATGAGCTGACCAAGAACCA<br>GGTCAGCCTGTGGTGCCTGGTCAAAGGCTTC<br>TATCCCAGCGACATCGCCGTGGAGTGGGAGA<br>GCAATGGGCAGCCGGAGAACAACTACAAGA<br>CCACGCCTCCCGTGCTGGACTCCGACGGCTC<br>CTTCTTCCTCTACAGCAAGCTCACCGTGGAC<br>AAGAGCAGGTGGCAGCAGGGGAACGTCTTC<br>TCATGCTCCGTGATGCATGAGGCTCTGCACA<br>ACCACTACACGCAGAAGAGCCTCTCCCTGTC<br>TCCGGGTAAATGA | 363 |

-continued

| DNA sequences | | |
|---|---|---|
| CEA $_{CH1A1A\ 98/99}$ (VH-CH1)-Fc(hole) P329GLALA | ATGGGATGGAGCTGTATCATCCTCTTCTTGGT AGCAACAGCTACCGGTGTGCATTCCCAGGTG CAGCTGGTGCAGTCTGGCGCCGAAGTGAAGA AACCTGGAGCTAGTGTGAAGGTGTCCTGCAA GGCCAGCGGCTACACCTTCACCGAGTTCGGC ATGAACTGGGTCCGACAGGCTCCAGGCCAGG GCCTCGAATGGATGGGCTGGATCAACACCAA GACCGGCGAGGCCACCTACGTGGAAGAGTTC AAGGGCAGAGTGACCTTCACCACGGACACC AGCACCAGCACCGCCTACATGGAACTGCGGA GCCTGAGAAGCGACGACACCGCCGTGTACTA CTGCGCCAGATGGGACTTCGCCTATTACGTG GAAGCCATGGACTACTGGGGCCAGGGCACC ACCGTGACCGTGTCTAGCGCTAGCACCAAGG GCCCCTCCGTGTTCCCCCTGGCCCCCAGCAG CAAGAGCACCAGCGGCGGCACAGCCGCTCT GGGCTGCCTGGTCAAGGACTACTTCCCCGAG CCCGTGACCGTGTCCTGGAACAGCGGAGCCC TGACCTCCGGCGTGCACACCTTCCCCGCCGT GCTGCAGAGTTCTGGCCTGTATAGCCTGAGC AGCGTGGTCACCGTGCCTTCTAGCAGCCTGG GCACCCAGACCTACATCTGCAACGTGAACCA CAAGCCCAGCAACACCAAGGTGGACAAGAA GGTGGAGCCCAAGAGCTGCGACAAAACTCA CACATGCCCACCGTGCCCAGCACCTGAAGCT GCAGGGGACCGTCAGTCTTCCTCTTCCCCC CAAAACCCAAGGACACCCTCATGATCTCCCG GACCCCTGAGGTCACATGCGTGGTGGTGGAC GTGAGCCACGAAGACCCTGAGGTCAAGTTCA ACTGGTACGTGGACGGCGTGGAGGTGCATAA TGCCAAGACAAAGCCGCGGGAGGAGCAGTA CAACAGCACGTACCGTGTGGTCAGCGTCCTC ACCGTCCTGCACCAGGACTGGCTGAATGGCA AGGAGTACAAGTGCAAGGTCTCCAACAAAG CCCTCGGCGCCCCCATCGAGAAAACCATCTC CAAAGCCAAAGGGCAGCCCCGAGAACCACA GGTGTGCACCCTGCCCCCATCCCGGGATGAG CTGACCAAGAACCAGGTCAGCCTCTCGTGCG CAGTCAAAGGCTTCTATCCCAGCGACATCGC CGTGGAGTGGGAGAGCAATGGGCAGCCGGA GAACAACTACAAGACCACGCCTCCCGTGCTG GACTCCGACGGCTCCTTCTTCCTCGTGAGCA AGCTCACCGTGGACAAGAGCAGGTGGCAGC AGGGGAACGTCTTCTCATGCTCCGTGATGCA TGAGGCTCTGCACAACCACTACACGCAGAAG AGCCTCTCCCTGTCTCCGGGTAAATGA | 364 |

| Untargeted DP47 | | SEQ ID NO. |
|---|---|---|
| Light Chain DP47 GS | ATGGGATGGAGCTGTATCATCCTCTTCTTGG TAGCAACAGCTACCGGTGTGCATTCCGAAA TCGTGTTAACGCAGTCTCCAGGCACCCTGTC TTTGTCTCCAGGGGAAAGAGCCACCCTCTCT TGCAGGGCCAGTCAGAGTGTTAGCAGCAGC TACTTAGCCTGGTACCAGCAGAAACCTGGC CAGGCTCCCAGGCTCCTCATCTATGGAGCA TCCAGCAGGGCCACTGGCATCCCAGACAGG TTCAGTGGCAGTGGATCCGGGACAGACTTC ACTCTCACCATCAGCAGACTGGAGCCTGAA GATTTTGCAGTGTATTACTGTCAGCAGTATG GTAGCTCACCGCTGACGTTCGGCCAGGGGA CCAAAGTGGAAATCAAACGTACGGTGGCTG CACCATCTGTCTTCATCTTCCCGCCATCTGA TGAGCAGTTGAAATCTGGAACTGCCTCTGTT GTGTGCCTGCTGAATAACTTCTATCCCAGAG AGGCCAAAGTACAGTGGAAGGTGGATAAC GCCCTCCAATCGGGTAACTCCCAGGAGAGT GTCACAGAGCAGGACAGCAAGGACAGCAC CTACAGCCTCAGCAGCACCCTGACGCTGAG CAAAGCAGACTACGAGAAACACAAAGTCTA CGCCTGCGAAGTCACCCATCAGGGCCTGAG CTCGCCCGTCACAAAGAGCTTCAACAGGGG AGAGTGTTAG | 365 |

| DNA sequences | | |
|---|---|---|
| Light Chain humanized CD3 $_{CH2527}$ (Crossfab, VL-CH1) | ATGGGATGGAGCTGTATCATCCTCTTCTTGG TAGCAACAGCTACCGGTGTGCATTCTCAGG CCGTCGTGACCCAGGAACCCAGCCTGACAG TGTCTCCTGGCGGCACCGTGACCCTGACAT GTGGCAGTTCTACAGGCGCCGTGACCACCA GCAACTACGCCAACTGGGTGCAGGAAAAGC CCGGCCAGGCCTTCAGAGGACTGATCGGCG GCACCAACAAGAGAGCCCCTGGCACCCCTG CCAGATTCAGCGGATCTCTGCTGGGAGGAA AGGCCGCCCTGACACTGTCTGGCGCCCAGC CAGAAGATGAGGCCGAGTACTACTGCGCCC TGTGGTACAGCAACCTGTGGGTGTTCGGCG GAGGCACCAAGCTGACAGTGCTGAGCAGCG CTTCCACCAAAGGCCCTTCCGTGTTCCTCT GGCTCCTAGCTCCAAGTCCACCTCTGGAGG CACCGCTGCTCTCGGATGCCTCGTGAAGGA TTATTTTCCTGAGCCTGTGACAGTGTCCTGG AATAGCGGAGCACTGACCTCTGGAGTGCAT ACTTTCCCCGCTGTGCTGCAGTCCTCTGGAC TGTACAGCCTGAGCAGCGTGGTGACAGTGC CCAGCAGCAGCCTGGGCACCCAGACCTACA TCTGCAACGTGAACCACAAGCCCAGCAACA CCAAGGTGGACAAGAAGGTGGAACCCAAG TCTTGTTGA | 366 |
| DP47 GS (VH-CH1)-humanized CD3 $_{CH2527}$ (Crossfab VH-Ck)-Fc(knob) P329GLALA | ATGGGATGGAGCTGTATCATCCTCTTCTTGG TAGCAACAGCTACCGGTGTGCATTCCGAGG TGCAATTGTTGGAGTCTGGGGGAGGCTTGG TACAGCCTGGGGGGTCCCTGAGACTCTCCT GTGCAGCCTCCGGATTCACCTTTAGCAGTTA TGCCATGAGCTGGGTCCGCCAGGCTCCAGG GAAGGGGCTGGAGTGGGTCTCAGCTATTAG TGGTAGTGGTGGTAGCACATACTACGCAGA CTCCGTGAAGGGCCGGTTCACCATCTCCAG AGACAATTCCAAGAACACGCTGTATCTGCA GATGAACAGCCTGAGAGCCGAGGACACGG CCGTATATTACTGTGCGAAAGGCAGCGGAT TTGACTACTGGGGCCAAGGAACCCTGGTCA CCGTCTCGAGTGCTAGCACAAAGGGCCCCA GCGTGTTCCCTCTGGCCCCTAGCAGCAAGA GCACATCTGGCGGAACAGCCGCCCTGGGCT GCCTCGTGAAGGACTACTTTCCCGAGCCTGT GACCGTGTCCTGGAACTCTGGCGCCCTGAC AAGCGGCGTGCACACCTTTCCAGCCGTGCT GCAGAGCAGCGGCCTGTACTCTCTGAGCAG CGTGGTCACCGTGCCTAGCAGCAGCCTGGG CACCCAGACCTACATCTGCAACGTGAACCA CAAGCCCAGCAACACCAAAGTGGACAAGA AGGTGGAGCCCAAGAGCTGTGATGGCGGAG GAGGGTCCGGAGGCGGAGGATCCGAGGTG CAGCTGCTGGAATCTGGCGGCGGACTGGTG CAGCCTGGCGGATCTCTGAGACTGAGCTGT GCCGCCAGCGGCTTCACCTTCAGCACCTAC GCCATGAACTGGGTGCGCCAGGCCCCTGGC AAAGGCCTGGAATGGGTGTCCCGGATCAGA AGCAAGTACAACAACTACGCCACCTACTAC GCCGACAGCGTGAAGGGCCGGTTCACCATC AGCCGGGACGACAGCAAGAACACCCTGTAC CTGCAGATGAACAGCCTGCGGGCCGAGGAC ACCGCCGTGTACTATTGTGTGCGGCACGGC AACTTCGGCAACAGCTATGTGTCTTGGTTTG CCTACTGGGGCCAGGGCACCCTCGTGACCG TGTCAAGCGCTAGCGTGGCCGCTCCCTCCGT GTTTATCTTTCCCCCATCCGATGAACAGCTG AAAAGCGGCACCGCCTCCGTCGTGTGTCTG CTGAACAATTTTTACCCTAGGGAAGCTAAA GTGCAGTGGAAAGTGGATAACGCACTGCAG TCCGGCAACTCCCAGGAATCTGTGACAGAA CAGGACTCCAAGGACAGCACCTACTCCCTG TCCTCCACCCTGACACTGTCTAAGGCTGATT ATGAGAAACACAAAGTCTACGCCTGCGAAG TCACCCATCAGGGCCTGAGCTCGCCCGTCA CAAAGAGCTTCAACAGGGGAGAGTGTACA AGACCCACACCTGTCCCCCTTGTCCTGCCCC TGAAGCTGCTGGCGGCCCTTCTGTGTTCCTG TTCCCCCCAAAGCCCAAGGACACCCTGATG ATCAGCCGGACCCCCGAAGTGACCTGCGTG | 367 |

-continued

| DNA sequences | | |
|---|---|---|
| | GTGGTGGATGTGTCCCACGAGGACCCTGAA<br>GTGAAGTTCAATTGGTACGTGGACGGCGTG<br>GAAGTGCACAACGCCAAGACAAAGCCGCG<br>GGAGGAGCAGTACAACAGCACGTACCGTGT<br>GGTCAGCGTCCTCACCGTCCTGCACCAGGA<br>CTGGCTGAATGGCAAGGAGTACAAGTGCAA<br>GGTCTCCAACAAAGCCCTCGGCGCCCCCAT<br>CGAGAAAACCATCTCCAAAGCCAAAGGGCA<br>GCCCCGAGAACCACAGGTGTACACCCTGCC<br>CCCATGCCGGGATGAGCTGACCAAGAACCA<br>GGTCAGCCTGTGGTGCCTGGTCAAAGGCTT<br>CTATCCCAGCGACATCGCCGTGGAGTGGGA<br>GAGCAATGGGCAGCCGGAGAACAACTACA<br>AGACCACGCCTCCCGTGCTGGACTCCGACG<br>GCTCCTTCTTCCTCTACAGCAAGCTCACCGT<br>GGACAAGAGCAGGTGGCAGCAGGGGAACG<br>TCTTCTCATGCTCCGTGATGCATGAGGCTCT<br>GCACAACCACTACACGCAGAAGAGCCTCTC<br>CCTGTCTCCGGGTAAATGA | |
| DP47 GS (VH-CH1)-<br>Fc(hole) P329GLALA | ATGGGATGGAGCTGTATCATCCTCTTCTTGG<br>TAGCAACAGCTACCGGTGTGCATTCCGAGG<br>TGCAATTGTTGGAGTCTGGGGGAGGCTTGG<br>TACAGCCTGGGGGGTCCCTGAGACTCTCCT<br>GTGCAGCCTCCGGATTCACCTTTAGCAGTTA<br>TGCCATGAGCTGGGTCCGCCAGGCTCCAGG<br>GAAGGGGCTGGAGTGGGTCTCAGCTATTAG<br>TGGTAGTGGTGGTAGCACATACTACGCAGA<br>CTCCGTGAAGGGCCGGTTCACCATCTCCAG<br>AGACAATTCCAAGAACACGCTGTATCTGCA<br>GATGAACAGCCTGAGAGCCGAGGACACGG<br>CCGTATATTACTGTGCGAAAGGCAGCGGAT<br>TTGACTACTGGGGCCAAGGAACCCTGGTCA<br>CCGTCTCGAGTGCTAGCACCAAGGGCCCCT<br>CCGTGTTCCCCCTGGCCCCCAGCAGCAAGA<br>GCACCAGCGGCGGCACAGCCGCTCTGGGCT<br>GCCTGGTCAAGGACTACTTCCCCGAGCCCG<br>TGACCGTGTCCTGGAACAGCGGAGCCCTGA<br>CCTCCGGCGTGCACACCTTCCCCGCCGTGCT<br>GCAGAGTTCTGGCCTGTATAGCCTGAGCAG<br>CGTGGTCACCGTGCCTTCTAGCAGCCTGGG<br>CACCCAGACCTACATCTGCAACGTGAACCA<br>CAAGCCCAGCAACACCAAGGTGGACAAGA<br>AGGTGGAGCCCAAGAGCTGCGACAAAACTC<br>ACACATGCCCACCGTGCCCAGCACCTGAAG<br>CTGCAGGGGACCGTCAGTCTTCCTCTTCCC<br>CCCAAAACCCAAGGACACCCTCATGATCTC<br>CCGGACCCCTGAGGTCACATGCGTGGTGGT<br>GGACGTGAGCCACGAAGACCCTGAGGTCAA<br>GTTCAACTGGTACGTGGACGGCGTGGAGGT<br>GCATAATGCCAAGACAAAGCCGCGGGAGG<br>AGCAGTACAACAGCACGTACCGTGTGGTCA<br>GCGTCCTCACCGTCCTGCACCAGGACTGGC<br>TGAATGGCAAGGAGTACAAGTGCAAGGTCT<br>CCAACAAAGCCCTCGGCGCCCCCATCGAGA<br>AAACCATCTCCAAAGCCAAAGGGCAGCCCC<br>GAGAACCACAGGTGTGCACCCTGCCCCCAT<br>CCCGGGATGAGCTGACCAAGAACCAGGTCA<br>GCCTCTCGTGCGCAGTCAAAGGCTTCTATCC<br>CAGCGACATCGCCGTGGAGTGGGAGAGCAA<br>TGGGCAGCCGGAGAACAACTACAAGACCAC<br>GCCTCCCGTGCTGGACTCCGACGGCTCCTTC<br>TTCCTCGTGAGCAAGCTCACCGTGGACAAG<br>AGCAGGTGGCAGCAGGGGAACGTCTTCTCA<br>TGCTCCGTGATGCATGAGGCTCTGCACAAC<br>CACTACACGCAGAAGAGCCTCTCCCTGTCT<br>CCGGGTAAATGA | 368 |
| Exemplary Farpin T-cell bispecific antibody | | SEQ ID NO. |
| Light Chain huminized CD3<br>CH2527 (Crossfab, VL-CH1) | ATGGGATGGAGCTGTATCATCCTCTTCTTGG<br>TAGCAACAGCTACCGGTGTGCATTCTCAGGC<br>CGTCGTGACCCAGGAACCCAGCCTGACAGT<br>GTCTCCTGGCGGCACCGTGACCCTGACATGT<br>GGCAGTTCTACAGGCGCCGTGACCACCAGC<br>AACTACGCCAACTGGGTGCAGGAAAAGCCC<br>GGCCAGGCCTTCAGAGGACTGATCGGCGGC | 386 |

| DNA sequences | |
|---|---|
| | ACCAACAAGAGAGCCCCTGGCACCCCTGCC<br>AGATTCAGCGGATCTCTGCTGGGAGGAAAG<br>GCCGCCCTGACACTGTCTGGCGCCCAGCCAG<br>AAGATGAGGCCGAGTACTACTGCGCCCTGT<br>GGTACAGCAACCTGTGGGTGTTCGGCGGAG<br>GCACCAAGCTGACAGTGCTGAGCAGCGCTT<br>CCACCAAAGGCCCTTCCGTGTTTCCTCTGGC<br>TCCTAGCTCCAAGTCCACCTCTGGAGGCACC<br>GCTGCTCTCGGATGCCTCGTGAAGGATTATT<br>TTCCTGAGCCTGTGACAGTGTCCTGGAATAG<br>CGGAGCACTGACCTCTGGAGTGCATACTTTC<br>CCCGCTGTGCTGCAGTCCTCTGGACTGTACA<br>GCCTGAGCAGCGTGGTGACAGTGCCCAGCA<br>GCAGCCTGGGCACCCAGACCTACATCTGCA<br>ACGTGAACCACAAGCCCAGCAACACCAAGG<br>TGGACAAGAAGGTGGAACCCAAGTCTTGTT<br>GA | |
| Darpin (HER2)-humanized<br>CD3 CH2527 (VH-CK)-<br>Fc(knob) P329GLALA | ATGGGATGGAGCTGTATCATCCTCTTCTTGG<br>TAGCAACAGCTACCGGTGTGCATTCCGATCT<br>GGGCAAGAAGCTGCTGGAAGCCGCCAGAGC<br>CGGCCAGGACGACGAAGTGCGGATCCTGAT<br>GGCCAACGGCGCCGACGTGAACGCCAAGGA<br>CGAGTACGGCCTGACCCCTCTGTATCTGGCC<br>ACAGCCCACGGCCACCTGGAAATCGTGGAG<br>GTGCTGCTGAAGAACGGGGCCGATGTGAAC<br>GCCGTGGACGCCATCGGCTTCACACCTCTGC<br>ACCTGGCCGCCTTCATCGGCCACCTCGAGAT<br>TGCCGAGGTCCTGCTGAAACATGGCGCTGAC<br>GTGAACGCTCAGGACAAGTTCGGCAAGACC<br>GCCTTCGACATCAGCATCGGCAACGGCAAC<br>GAGGACCTGGCCGAGATCCTGCAGAAGCTG<br>GGCGGAGGAGGGTCCGGAGGCGGAGGATCC<br>GAGGTGCAGCTGCTGGAATCTGGCGGCGGA<br>CTGGTGCAGCCTGGCGGATCTCTGAGACTGA<br>GCTGTGCCGCCAGCGGCTTCACCTTCAGCAC<br>CTACGCCATGAACTGGGTGCGCCAGGCCCCT<br>GGCAAAGGCCTGGAATGGGTGTCCCGGATC<br>AGAAGCAAGTACAACAACTACGCCACCTAC<br>TACGCCGACAGCGTGAAGGGCCGGTTCACC<br>ATCAGCCGGGACGACAGCAAGAACACCCTG<br>TACCTGCAGATGAACAGCCTGCGGGCCGAG<br>GACACCGCCGTGTACTATTGTGTGCGGCACG<br>GCAACTTCGGCAACAGCTATGTGTCTTGGTT<br>TGCCTACTGGGGCCAGGGCACCCTCGTGACC<br>GTGTCAAGCGCTAGCGTGGCCGCTCCCTCCG<br>TGTTTATCTTTCCCCCATCCGATGAACAGCT<br>GAAAAGCGGCACCGCCTCCGTCGTGTGTCTG<br>CTGAACAATTTTTACCCTAGGGAAGCTAAAG<br>TGCAGTGGAAAGTGGATAACGCACTGCAGT<br>CCGGCAACTCCCAGGAATCTGTGACAGAAC<br>AGGACTCCAAGGACAGCACCTACTCCCTGTC<br>CTCCACCCTGACACTGTCTAAGGCTGATTAT<br>GAGAAACACAAAGTCTACGCCTGCGAAGTC<br>ACCCATCAGGGCCTGAGCTCGCCCGTCACAA<br>AGAGCTTCAACAGGGGAGAGTGTGACAAGA<br>CCCACACCTGTCCCCCTTGTCCTGCCCCTGA<br>AGCTGCTGGCGGCCCTTCTGTGTTCCTGTTC<br>CCCCCAAAGCCCAAGGACACCCTGATGATC<br>AGCCGGACCCCCGAAGTGACCTGCGTGGTG<br>GTGGATGTGTCCCACGAGGACCCTGAAGTG<br>AAGTTCAATTGGTACGTGGACGGCGTGGAA<br>GTGCACAACGCCAAGACAAAGCCGCGGGAG<br>GAGCAGTACAACAGCACGTACCGTGTGGTC<br>AGCGTCCTCACCGTCCTGCACCAGGACTGGC<br>TGAATGGCAAGGAGTACAAGTGCAAGGTCT<br>CCAACAAAGCCCTCGGCGCCCCCATCGAGA<br>AAACCATCTCCAAAGCCAAAGGGCAGCCCC<br>GAGAACCACAGGTGTACACCCTGCCCCCAT<br>GCCGGGATGAGCTGACCAAGAACCAGGTCA<br>GCCTGTGGTGCCTGGTCAAAGGCTTCTATCC<br>CAGCGACATCGCCGTGGAGTGGGAGAGCAA<br>TGGGCAGCCGGAGAACAACTACAAGACCAC<br>GCCTCCCGTGCTGGACTCCGACGGCTCCTTC<br>TTCCTCTACAGCAAGCTCACCGTGGACAAGA<br>GCAGGTGGCAGCAGGGGAACGTCTTCTCAT | 387 |

| | DNA sequences | |
|---|---|---|
| | GCTCCGTGATGCATGAGGCTCTGCACAACCA CTACACGCAGAAGAGCCTCTCCCTGTCTCCG GGTAAATGA | |
| Darpin $_{(HER2)}$-Fc(hole) P329GLALA | ATGGGATGGAGCTGTATCATCCTCTTCTTGG TAGCAACAGCTACCGGTGTGCATTCCGATCT GGGCAAGAAGCTGCTGGAAGCCGCCAGAGC CGGCCAGGACGACGAAGTGCGGATCCTGAT GGCCAACGGCGCCGACGTGAACGCCAAGGA CGAGTACGGCCTGACCCCTCTGTATCTGGCC ACAGCCCACGGCCACCTGGAAATCGTGGAG GTGCTGCTGAAGAACGGGGCCGATGTGAAC GCCGTGGACGCCATCGGCTTCACACCTCTGC ACCTGGCCGCCTTCATCGGCCACCTCGAGAT TGCCGAGGTCCTGCTGAAACATGGCGCTGAC GTGAACGCTCAGGACAAGTTCGGCAAGACC GCCTTCGACATCAGCATCGGCAACGGCAAC GAGGACCTGGCCGAGATCCTGCAGAAGCTG GACAAAACTCACACATGCCCACCGTGCCCA GCACCTGAAGCTGCAGGGGGACCGTCAGTC TTCCTCTTCCCCCCAAAACCCAAGGACACCC TCATGATCTCCCGGACCCCTGAGGTCACATG CGTGGTGGTGGACGTGAGCCACGAAGACCC TGAGGTCAAGTTCAACTGGTACGTGGACGG CGTGGAGGTGCATAATGCCAAGACAAAGCC GCGGGAGGAGCAGTACAACAGCACGTACCG TGTGGTCAGCGTCCTCACCGTCCTGCACCAG GACTGGCTGAATGGCAAGGAGTACAAGTGC AAGGTCTCCAACAAAGCCCTCGGCGCCCCC ATCGAGAAAACCATCTCCAAAGCCAAAGGG CAGCCCCGAGAACCACAGGTGTGCACCCTG CCCCCATCCCGGGATGAGCTGACCAAGAAC CAGGTCAGCCTCTCGTGCGCAGTCAAAGGCT TCTATCCCAGCGACATCGCCGTGGAGTGGGA GAGCAATGGGCAGCCGGAGAACAACTACAA GACCACGCCTCCCGTGCTGGACTCCGACGGC TCCTTCTTCCTCGTGAGCAAGCTCACCGTGG ACAAGAGCAGGTGGCAGCAGGGGAACGTCT TCTCATGCTCCGTGATGCATGAGGCTCTGCA CAACCACTACACGCAGAAGAGCCTCTCCCTG TCTCCGGGTAAATGA | 388 |

Although the foregoing invention has been described in some detail by way of illustration and example for purposes of clarity of understanding, the descriptions and examples should not be construed as limiting the scope of the invention. The disclosures of all patent and scientific literature cited herein are expressly incorporated in their entirety by reference.

SEQUENCE LISTING (390 sequences)

SEQ ID NO: 1 - protein, 700 aa, Artificial Sequence
  V9 (scFab)-Fc(hole) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 2 - DNA, 2103 bp, Artificial Sequence
  V9 (scFab)-Fc(hole) P329G LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 3 - protein, 442 aa, Artificial Sequence
  LC007 (VH-CH1)-Fc(knob) P329G LALA
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - DNA, 1329 bp, Artificial Sequence
  LC007 (VH-CH1)-Fc(knob) P329G LALA
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 5 - protein, 214 aa, Artificial Sequence
  LC007 (VL-CL)
DIVLTQSPSSLSASLGDRVTISCSASQGIRNYLNWYQQRPDGTVKLLIYYTSSLHSGVPSRFSGSGSGTDYSLTISNLEPEDIATYYCQQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - DNA, 645 bp, Artificial Sequence
  LC007 (VL-CL)
gatattgtgctcacacagtctccatcctccctgtctgcctctctgggagacagagtcaccatcagttgcagtgcaagtcagggcattagaaattatttaaactggtatcagcagagaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaagcttccttggacgttcggtggaggcaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 7 - protein, 704 aa, Artificial Sequence
  LC007 (scFab)-Fc(hole) P329G LALA
DIVLTQSPSSLSASLGDRVTISCSASQGIRNYLNWYQQRPDGTVKLLIYYTSSLHSGVPSRFSGSGSGTDYSLTISNLEPEDIATYYCQQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSGAQDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 8 - DNA, 2115 bp, Artificial Sequence
  LC007 (scFab)-Fc(hole) P329G LALA
gacatcgtgctgacccagagccctagcagcctgagcgccagcctgggcgacagagtgaccatcagctgtagcgcctcccagggcatcagaaactacctgaactggtatcagcagagacccgacggcacagtgaagctgctgatctactacaccagcagcctgcacagcggcgtgccaagcagattcagcggcagcggctccggcacagactacagcctgaccatctccaacctggaacccgaggatatcgccacctactactgccagcagtacagcaagctgccctggaccttcggcggaggcaccaagctggaaatcaagcggaccgtggccgctcccagcgtgttcatcttcccacccagcgacgagcagctgaagtccggcacagccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgtccagcaccctgaccctgagcaaggccgactacgagaagcacaaggtgtacgcctgcgaagtgacccaccagggcctgagcagccccgtgaccaagagcttcaaccggggcgagtgtagtggcggaggctctggcggaggaagcgagggcggaggatctgaaggcggcggatctgaggggggaggcagtgaagggggaggctcagggggaggatccggcgaggtgcagctgcaggaatctggccctggcctggtcaagccaagccagagtctgagcctgacctgcagcgtgaccggctacagcattaccagcggctactactggaactggattcggcagttccccggcaataagctggaatggatgggctacatcacctacgacggcagcaacaactacaaccccagcctgaagaaccggatcagcatcacccgggacaccagcaagaaccagttcttcctgaagctgaacagcgtgaccaccgaggacaccgccacatactattgcgccgacttcgactactggggccagggcaccaccctgaccgtgtccagcgccagcacaaagggccctagcgtgttccctctggcccccagcagcaagagcacaagcggcggaacagccgccctgggctgcctcgtgaaggactacttccccgagcccgtgacagtgtcttggaacagcggagccctgacaagcggcgtgcacaccttccctgccgtgctgcagagcagcggcctgtactccctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggtggatccggagctcaggacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 9 - protein, 466 aa, Artificial Sequence
  V9 (VH-CH1) -Fc(knob) LALA
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSGAQDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - DNA, 1401 bp, Artificial Sequence
  V9 (VH-CH1) -Fc(knob) LALA
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacggcggtggtggctccggaggcggtggatccggagctcaggacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 11 - protein, 214 aa, Artificial Sequence
  V9 (VL-CL)
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - DNA, 645 bp, Artificial Sequence
  V9 (VL-CL)
gacatccagatgacccagagccccagcagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactgccctggaccttcggccagggcacaaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 13 - protein, 926 aa, Artificial Sequence [sequence omitted]

SEQ ID NO: 14 - DNA, 2781 bp, Artificial Sequence
  V9 (scFab)-LC007 (VH-CH1)-Fc(knob) wt
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggcggtggatctgaagtgcagctgcaggaaagcggccctggcctggtcaagcccagccagagcctgagcctgacctgtagcgtgaccggctactccatcacctccggctactactggaattggattcggcagttccccggcaacaagctggaatggatgggctacatcacctacgacggcagcaacaactacaaccccagcctgaagaaccggatcagcatcacccgggacaccagcaagaaccagttcttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 15 - protein, 442 aa, Artificial Sequence
  LC007 (VH-CH1)-Fc(hole) wt
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 16 - DNA, 1329 bp, Artificial Sequence
  LC007 (VH-CH1)-Fc(hole) wt
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctcagctagcaccaagggcccaagcgtgttccctctggcccccagcagcaagagcacaagcggcggaacagccgccctgggctgcctggtcaaggactacttccccgagcccgtgacagtgtcctggaacagcggagccctgaccagcggcgtgcacacctttccagccgtgctgcagagcagcggcctgtacagcctgagcagcgtggtcacagtgcctagcagcagcctgggcacccagacctacatctgcaacgtgaaccacaagcccagcaacaccaaggtggacaagaaggtggagcccaagagctgcgacaagacccacacctgtcccccttgtcctgcccctgagctgctgggcggacccagcgtgttcctgttccccccaaagcccaaggacaccctgatgatcagccggacccccgaagtgacctgcgtggtggtggacgtgtcccacgaggaccctgaagtgaagttcaattggtacgtggacggcgtggaggtgcacaatgccaagaccaagccccgggaggaacagtacaacagcacctaccgggtggtgtccgtgctgaccgtgctgcaccaggactggctgaacggcaaagagtacaagtgcaaggtctccaacaaggccctgcctgcccccatcgagaaaaccatcagcaaggccaagggccagcccagagaaccccaggtgtgcaccctgccccccagcagagatgagctgaccaagaaccaggtgtccctgagctgtgccgtcaagggcttctaccccagcgatatcgccgtggagtgggagagcaacggccagcctgagaacaactacaagaccaccccccctgtgctggacagcgacggcagcttcttcctggtgtccaaactgaccgtggacaagagccggtggcagcagggcaacgtgttcagctgcagcgtgatgcacgaggccctgcacaaccactacacccagaagtccctgagcctgagccccggcaagtga

SEQ ID NO: 17 - protein, 926 aa, Artificial Sequence
  V9 (scFab)-LC007 (VH-CH1)-Fc(knob) LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - DNA, 2781 bp, Artificial Sequence
  V9 (scFab)-LC007 (VH-CH1)-Fc(knob) LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggcggtggatctgaagtgcagctgcaggaaagcggccctggcctggtcaagcccagccagagcctgagcctgacctgtagcgtgaccggctactccatcacctccggctactactggaattggattcggcagttccccggcaacaagctggaatggatgggctacatcacctacgacggcagcaacaactacaaccccagcctgaagaaccggatcagcatcacccgggacaccagcaagaaccagttcttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 19 - protein, 442 aa, Artificial Sequence
  LC007 (VH-CH1)-Fc(hole) LALA
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 20 - DNA, 1329 bp, Artificial Sequence
  LC007 (VH-CH1)-Fc(hole) LALA
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 21 - protein, 926 aa, Artificial Sequence
  V9 (scFab)-LC007 (VH-CH1)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - DNA, 2781 bp, Artificial Sequence
  V9 (scFab)-LC007 (VH-CH1)-Fc(knob) P329G LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggcggtggatctgaagtgcagctgcaggaaagcggccctggcctggtcaagcccagccagagcctgagcctgacctgtagcgtgaccggctactccatcacctccggctactactggaattggattcggcagttccccggcaacaagctggaatggatgggctacatcacctacgacggcagcaacaactacaaccccagcctgaagaaccggatcagcatcacccgggacaccagcaagaaccagttcttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 23 - protein, 442 aa, Artificial Sequence
  LC007 (VH-CH1)-Fc(hole) P329G LALA
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 24 - DNA, 1329 bp, Artificial Sequence
  LC007 (VH-CH1)-Fc(hole) P329G LALA
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 25 - protein, 926 aa, Artificial Sequence
  V9 (scFab)-LC007 (VH-CH1)-Fc(knob) P329G LALA N297D
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYDSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - DNA, 2781 bp, Artificial Sequence
  V9 (scFab)-LC007 (VH-CH1)-Fc(knob) P329G LALA N297D
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggcggtggatctgaagtgcagctgcaggaaagcggccctggcctggtcaagcccagccagagcctgagcctgacctgtagcgtgaccggctactccatcacctccggctactactggaattggattcggcagttccccggcaacaagctggaatggatgggctacatcacctacgacggcagcaacaactacaaccccagcctgaagaaccggatcagcatcacccgggacaccagcaagaaccagttcttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 27 - protein, 442 aa, Artificial Sequence
  LC007 (VH-CH1)-Fc(hole) P329G LALA N297D
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYDSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 28 - DNA, 1329 bp, Artificial Sequence
  LC007 (VH-CH1)-Fc(hole) P329G LALA N297D
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 29 - protein, 664 aa, Artificial Sequence
  V9 (VL-CH1)-LC007 (VH-CH1)-Fc(hole) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 30 - DNA, 1995 bp, Artificial Sequence
  V9 (VL-CH1)-LC007 (VH-CH1)-Fc(hole) P329G LALA
gatatccagatgacccagagccccagctctctgagcgccagcgtgggcgacagagtgaccatcacctgtcgggccagccaggacatcagaaactacctgaactggtatcagcagaagcccggcaaggcccccaagctgctgatctactacaccagcagactggaaagcggcgtgccctccagattttccggcagcggctccggcaccgactacaccctgaccatcagcagcctgcagcccgaggatttcgccacatattactgccagcagggcaataccctgccctggaccttcggacagggcacaaaagtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggagggggatctgaggtgcagctgcaggaaagcggccctggcctggtgaaacccagccagagcctgagcctgacctgcagcgtgaccggctacagcatcaccagcggctactactggaactggatcagacagttccccggcaacaagctggaatggatgggctacatcacctacgacggcagcaacaactacaaccccagcctgaagaacagaatcagcatcacccgggacaccagcaagaaccagttcttcctgaagctgaacagcgtgaccaccgaggacaccgccacctactactgcgccgacttcgactactggggccagggcaccaccctgaccgtgtcctccgcctctaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 31 - protein, 229 aa, Artificial Sequence
  Fc(knob) wt
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSG

SEQ ID NO: 32 - DNA, 690 bp, Artificial Sequence
  Fc(knob) wt
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggatga

SEQ ID NO: 33 - protein, 229 aa, Artificial Sequence
  V9 (VH-CL)
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - DNA, 690 bp, Artificial Sequence
  V9 (VH-CL)
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagcgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 35 - protein, 670 aa, Artificial Sequence
  FN18 (VL-CH1)-LC007 (VH-CH1)-Fc(hole) P329G LALA
DIVMSQSPSSLAVSVGEKVTMSCKSSQSLLYSSNQKNYLAWYQQKPGQSPKLLINWASTRESGVPDRFTGSGSRTDFTLTISSVKAEDLAVYFCQQFYSYPPTFGGGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 36 - DNA, 2013 bp, Artificial Sequence
  FN18 (VL-CH1)-LC007 (VH-CH1)-Fc(hole) P329G LALA
gacatcgtgatgagccagagccccagcagcctggccgtgtccgtgggcgagaaagtgaccatgagctgcaagagcagccagagcctgctgtactcctctaaccagaagaactacctggcctggtatcagcagaagcccggccagtcccccaagctgctgatcaactgggccagcacccgcgagagcggcgtgcccgatagattcacaggcagcggcagccggaccgacttcaccctgaccatcagcagcgtgaaggccgaggatctggccgtgtacttctgccagcagttctacagctacccccccaccttcggcggaggcacgaagctggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggagggggatctgaggtgcagctgcaggaaagcggccctggcctggtgaaacccagccagagcctgagcctgacctgcagcgtgaccggctacagcatcaccagcggctactactggaactggatcagacagttccccggcaacaagctggaatggatgggctacatcacctacgacggcagcaacaactacaaccccagcctgaagaacagaatcagcatcacccgggacaccagcaagaaccagttcttcctgaagctgaacagcgtgaccaccgaggacaccgccacctactactgcgccgacttcgactactggggccagggcaccaccctgaccgtgtcctccgcctctaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 37 - protein, 231 aa, Artificial Sequence
  FN18 (VH-CL)
QVQLQQSEAELARPGASVKMSCKASGYTFTDYTIHWLKQRPGQGLDWIGYFNPSSESTEYNRKFKDRTILTADRSSTTAYMQLSSLTSEDSAVYYCSRKGEKLLGNRYWYFDVWGAGTSVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 38 - DNA, 696 bp, Artificial Sequence
  FN18 (VH-CL)
caggtgcagctgcagcagagcgaggccgagctggctagacctggagccagcgtgaagatgagctgcaaggccagcggctacaccttcaccgactacaccatccactggctgaagcagcggcctggacagggcctggactggatcggctacttcaaccccagcagcgagagcaccgagtacaaccggaagttcaaggaccggaccatcctgaccgccgacagaagcagcaccaccgcctacatgcagctgagcagcctgaccagcgaggacagcgccgtgtactactgcagccggaagggcgagaagctgctgggcaacagatactggtacttcgacgtgtggggagccggcaccagcgtgaccgtgtctagcgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 39 - protein, 664 aa, Artificial Sequence
  2C11 (VL-CH1)-LC007 (VH-CH1)-Fc(hole) P329G LALA
DIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 40 - DNA, 1995 bp, Artificial Sequence
  2C11 (VL-CH1)-LC007 (VH-CH1)-Fc(hole) P329G LALA
gacatccagatgacccagagccccagcagcctgcctgccagcctgggcgacagagtgaccatcaactgccaggccagccaggacatcagcaactacctgaactggtatcagcagaagcctggcaaggcccccaagctgctgatctactacaccaacaagctggccgacggcgtgcccagcagattcagcggcagcggctccggcagagacagcagcttcaccatctccagcctggaaagcgaggacatcggcagctactactgccagcagtactacaactacccctggaccttcggccctggcaccaagctggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggagggggatctgaggtgcagctgcaggaaagcggccctggcctggtgaaacccagccagagcctgagcctgacctgcagcgtgaccggctacagcatcaccagcggctactactggaactggatcagacagttccccggcaacaagctggaatggatgggctacatcacctacgacggcagcaacaactacaaccccagcctgaagaacagaatcagcatcacccgggacaccagcaagaaccagttcttcctgaagctgaacagcgtgaccaccgaggacaccgccacctactactgcgccgacttcgactactggggccagggcaccaccctgaccgtgtcctccgcctctaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 41 - protein, 223 aa, Artificial Sequence
  2C11 (VH-CL)
EVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - DNA, 672 bp, Artificial Sequence
  2C11 (VH-CL)
gaggtgcagctggtggaaagcggcggaggcctggtgcagcccggcaagagcctgaagctgagctgcgaggccagcggcttcaccttcagcggctacggcatgcactgggtgagacaggcccctggcagaggactggaaagcgtggcctacatcaccagcagcagcatcaacattaagtacgccgacgccgtgaagggccggttcaccgtgtccagggataacgccaagaacctgctgttcctgcagatgaacatcctgaagtccgaggacaccgctatgtattactgcgccagattcgactgggacaagaactactggggccagggcaccatggtcacagtgtctagcgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 43 - protein, 700 aa, Artificial Sequence
  V9 (scFab)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - DNA, 2103 bp, Artificial Sequence
  V9 (scFab)-Fc(knob) P329G LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 45 - protein, 450 aa, Artificial Sequence
  GA201 (VH-CH1)-Fc(hole) P329G LALA
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 46 - DNA, 1353 bp, Artificial Sequence
  GA201 (VH-CH1)-Fc(hole) P329G LALA
caggtgcagctggtgcagtctggggctgaggtgaagaagcctgggtcctcggtgaaggtctcctgcaaggcctctggtttcacattcactgactacaagatacactgggtgcgacaggcccctggacaagggctcgagtggatgggatatttcaaccctaacagcggttatagtacctacgcacagaagttccagggcagggtcaccattaccgcggacaaatccacgagcacagcctacatggagctgagcagcctgagatctgaggacacggccgtgtattactgtgcgagactatccccaggcggttactatgttatggatgcctggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 47 - protein, 213 aa, Artificial Sequence
  GA201 (VL-CL)
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - DNA, 642 bp, Artificial Sequence
  GA201 (VL-CL)
gatatccagatgacccagtctccatcctccctgtctgcatctgtcggagaccgggtcaccatcacctgccgggcaagtcagggcattaacaattacttaaattggtaccagcagaagccagggaaagcccctaagcgcctgatctataataccaacaacttgcagacaggcgtcccatcaaggttcagcggcagtggatccgggacagaattcactctcaccatcagcagcctgcagcctgaagattttgccacctattactgcttgcagcataatagttttcccacgtttggccagggcaccaagctcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 49 - protein, 697 aa, Artificial Sequence
  GA201 (scFab)-Fc(knob) P329G LALA
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGQVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - DNA, 2094 bp, Artificial Sequence
  GA201 (scFab)-Fc(knob) P329G LALA
gatatccagatgacccagtctccatcctccctgtctgcatctgtcggagaccgggtcaccatcacctgccgggcaagtcagggcattaacaattacttaaattggtaccagcagaagccagggaaagcccctaagcgcctgatctataataccaacaacttgcagacaggcgtcccatcaaggttcagcggcagtggatccgggacagaattcactctcaccatcagcagcctgcagcctgaagattttgccacctattactgcttgcagcataatagttttcccacgtttggccagggcaccaagctcgagatcaagcgtacggtggccgctcccagcgtgttcatcttcccccccagcgacgagcagctgaaatctggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctatagcctgtccagcaccctgaccctgagcaaggccgactacgagaagcacaaggtgtacgcctgcgaagtgacccaccagggcctgagcagccccgtgaccaagagcttcaaccggggcgagtgcagcggcggaggtagcggaggcggctctgagggcggaggaagcgagggcggaggctccgaaggcggcggaagcgaaggtggcggctctggcggcggatccggccaggtgcagctggtgcagtctggggctgaggtgaagaagcctgggtcctcggtgaaggtctcctgcaaggcctctggtttcacattcactgactacaagatacactgggtgcgacaggcccctggacaagggctcgagtggatgggatatttcaaccctaacagcggttatagtacctacgcacagaagttccagggcagggtcaccattaccgcggacaaatccacgagcacagcctacatggagctgagcagcctgagatctgaggacacggccgtgtattactgtgcgagactatccccaggcggttactatgttatggatgcctggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 51 - protein, 452 aa, Artificial Sequence
  V9 (VH-CH1)-Fc(hole) P329G LALA
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 52 - DNA, 1359 bp, Artificial Sequence
  V9 (VH-CH1)-Fc(hole) P329G LALA
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 53 - protein, 934 aa, Artificial Sequence [sequence omitted]

SEQ ID NO: 54 - DNA, 2805 bp, Artificial Sequence
  V9 (scFab)-GA201 (VH-CH1)-Fc(knob) P329G LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggcggtggatctcaggtgcagctggtgcagtctggggctgaggtgaagaagcctgggtcctcggtgaaggtctcctgcaaggcctctggtttcacattcactgactacaagatacactgggtgcgacaggcccctggacaagggctcgagtggatgggatatttcaaccctaacagcggttatagtacctacgcacagaagttccagggcagggtcaccattaccgcggacaaatccacgagcacagcctacatggagctgagcagcctgagatctgaggacacggccgtgtattactgtgcgagactatccccaggcggttactatgttatggatgcctggggccaagggaccaccgtgaccgtctcctcagctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 55 - protein, 694 aa, Artificial Sequence
  3F2 (scFab)-Fc(knob) P329G LALA
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSGGGGSGGGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - DNA, 2085 bp, Artificial Sequence
  3F2 (scFab)-Fc(knob) P329G LALA
gagatcgtgctgacacagagccccggaaccctgtctctgagccctggcgaaagagccaccctgagctgtagagccagccagagcgtgaccagcagctacctggcctggtatcagcagaagcctggacaggcccccagactgctgatcaatgtgggcagcagacgggccaccggcatccctgatagattttctggcagcggcagcggcaccgacttcaccctgaccatcagcagactggaacccgaggacttcgccgtgtactactgccagcagggcatcatgctgccccctacatttggccagggcaccaaggtggaaatcaagcgtacggtggccgctcccagcgtgttcatcttcccacctagcgacgagcagctgaagtctggcacagccagcgtcgtgtgcctgctgaacaacttctacccccgcgaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggagaatgtggcggcggaggatctggtggcggaggtagtggtggtggtggatctggcggaggcggatccggcggaggtggaagcggaggtggtggaagtgggggagaagtgcagctgctggaaagtggcggaggcctggtgcagcctggcggatctctgagactgagctgtgccgccagcggcttcacctttagcagctacgccatgagctgggtccgacaggcccctggaaagggactggaatgggtgtccgccatctctggctctggcggcagcacctactacgccgatagcgtgaagggccggttcaccatcagccgggacaacagcaagaacaccctgtacctgcagatgaacagcctgcgggccgaggataccgccgtgtattattgcgccaagggatggttcggcggcttcaactattggggccagggaaccctggtcaccgtgtctagtgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 57 - protein, 931 aa, Artificial Sequence
  V9 (scFab)-3F2 (VH-CH1)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGSGGGSEGGGSEGGGSEGGGSEGGGSGGGSGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - DNA, 2796 bp, Artificial Sequence
  V9 (scFab)-3F2 (VH-CH1)-Fc(knob) P329G LALA
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagcgtacggtggccgctcccagcgtgttcatcttcccccccagcgacgagcagctgaagtccggcaccgccagcgtcgtgtgcctgctgaacaacttctacccccgggaggccaaggtgcagtggaaggtggacaacgccctgcagagcggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcagcggcggaggctctggaggcggctctgaaggcggaggaagtgagggcggaggctcagaaggcggcggaagcgaaggtggcggctctggcggcggatccggcgaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagcgctagcaccaagggcccctccgtgttccccctggcccccagcagcaagagcaccagcggcggcacagccgccctcggctgcctggtcaaggactacttccccgagcccgtgaccgtgtcctggaacagcggagccctgacctccggcgtgcacaccttccccgccgtgctgcagagcagcggcctgtacagcctgtccagcgtggtcaccgtgccctccagcagcctgggcacccagacctacatctgcaacgtgaaccacaagcccagcaataccaaggtggacaagaaggtggagcccaagagctgcgacggcggtggtggctccggaggaggaggcagcgaggtgcagctgctggaatctggaggcggcctggtgcagcctggcggcagcctgagactgtcttgcgccgccagcggcttcaccttcagcagctacgccatgagctgggtccgacaggctcctggcaagggactggaatgggtgtccgccatctccggcagcggaggcagcacctactacgccgacagcgtgaagggccggttcaccatcagcagagacaacagcaagaacaccctgtacctgcagatgaacagcctgcgggccgaggataccgccgtgtattattgcgccaagggatggttcggcggcttcaactactggggccagggaaccctggtgacagtgtccagcgccagcaccaagggcccctccgtgtttcctctggcccccagcagcaagagcacctctggcggaacagccgccctgggctgcctggtgaaagactacttccccgagcccgtgaccgtgtcctggaactctggcgccctgaccagcggcgtgcacacctttccagccgtgctgcagagcagcggcctgtactccctgagcagcgtggtgacagtgccctccagcagcctgggcacccagacctacatctgcaacgtgaaccacaagcccagcaacaccaaagtggacaagaaggtggaacccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 59 - protein, 447 aa, Artificial Sequence
  3F2 (VH-CH1)-Fc(hole) P329G LALA
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 60 - DNA, 1344 bp, Artificial Sequence
  3F2 (VH-CH1)-Fc(hole) P329G LALA
gaggtgcagctgctggaatctggaggcggcctggtgcagcctggcggcagcctgagactgtcttgcgccgccagcggcttcaccttcagcagctacgccatgagctgggtccgacaggctcctggcaagggactggaatgggtgtccgccatctccggcagcggaggcagcacctactacgccgacagcgtgaagggccggttcaccatcagcagagacaacagcaagaacaccctgtacctgcagatgaacagcctgcgggccgaggataccgccgtgtattattgcgccaagggatggttcggcggcttcaactactggggccagggaaccctggtgacagtgtccagcgccagcaccaagggcccctccgtgtttcctctggcccccagcagcaagagcacctctggcggaacagccgccctgggctgcctggtgaaagactacttccccgagcccgtgaccgtgtcctggaactctggcgccctgaccagcggcgtgcacacctttccagccgtgctgcagagcagcggcctgtactccctgagcagcgtggtgacagtgccctccagcagcctgggcacccagacctacatctgcaacgtgaaccacaagcccagcaacaccaaagtggacaagaaggtggaacccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 61 - protein, 215 aa, Artificial Sequence
  3F2 (VL-CL)
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - DNA, 648 bp, Artificial Sequence
  3F2 (VL-CL)
gagatcgtgctgacccagtctcccggcaccctgagcctgagccctggcgagagagccaccctgagctgcagagccagccagagcgtgaccagcagctacctggcctggtatcagcagaagcccggccaggcccccagactgctgatcaacgtgggcagcagacgggccaccggcatccccgatagattcagcggcagcggctccggcaccgacttcaccctgaccatcagccggctggaacccgaggacttcgccgtgtactactgccagcagggcatcatgctgccccccaccttcggccagggcaccaaggtggaaatcaagcggaccgtggccgctcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaatccgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgctga

SEQ ID NO: 63 - protein, 673 aa, Artificial Sequence
  CH1A1A (VH-CH1)- V9 (VL-CH1)-Fc(knob) P329G LALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - DNA, 2022 bp, Artificial Sequence
  CH1A1A (VH-CH1)- V9 (VL-CH1)-Fc(knob) P329G LALA
caggtgcagctggtgcagtctggcgccgaagtgaagaaacctggcgccagcgtgaaggtgtcctgcaaggccagcggctacaccttcaccgagttcggcatgaactgggtccgacaggcccctggacagggcctggaatggatgggctggatcaacaccaagaccggcgaggccacctacgtggaagagttcaagggcagagtgaccttcaccaccgacaccagcaccagcaccgcctacatggaactgcggagcctgagaagcgacgacaccgccgtgtactactgcgccagatgggacttcgcctactatgtggaagccatggactactggggccagggcaccaccgtgaccgtgtctagtgctagcacaaagggccccagcgtgttccctctggcccctagcagcaagagcacatctggcggaacagccgccctgggctgcctggtcaaggactactttcccgagcccgtgacagtgtcctggaactctggcgccctgacaagcggcgtgcacacctttccagccgtgctgcagagcagcggcctgtactctctgagcagcgtggtcaccgtgcctagctctagcctgggcacccagacctacatctgcaacgtgaaccacaagcccagcaacaccaaggtggacaagaaggtggaacccaagagctgcggcggaggcggatccggaggcggaggatctgatatccagatgacccagagccccagcagcctgtctgccagcgtgggcgacagagtgaccattacctgcagagccagccaggacatcagaaactacctgaactggtatcagcagaagcccggcaaggcccccaagctgctgatctactacaccagcagactggaatccggcgtgcccagcagattttccggcagcggctctggcaccgactacaccctgacaatcagcagcctgcagcccgaggacttcgccacctactactgccagcagggcaacaccctgccctggacatttggacagggcacaaaggtggaaatcaagagcagcgcctccaccaagggcccttccgtgtttccactggcccccagctctaagagcaccagcggaggaacagctgctctgggatgtctcgtgaaggattacttccccgaacctgtgaccgtcagctggaacagcggcgctctgacatctggggtgcacacattccccgctgtcctgcagtcctccggcctgtacagtctgtccagcgtcgtgacagtgcctagcagctccctgggaacacagacatatatctgtaatgtcaatcacaagccctctaataccaaggtcgacaaaaaagtcgagcccaagtcctgcgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 65 - protein, 451 aa, Artificial Sequence
  CH1A1A (VH-CH1)-Fc(hole) P329G LALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 66 - DNA, 1356 bp, Artificial Sequence
  CH1A1A (VH-CH1)-Fc(hole) P329G LALA
caggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 67 - protein, 215 aa, Artificial Sequence
  CH1A1A (VL-CL)
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - DNA, 648 bp, Artificial Sequence
  CH1A1A (VL-CL)
gatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 69 - protein, 11 aa, Artificial Sequence
  LC007 HCDR1
GYSITSGYYWN

SEQ ID NO: 70 - DNA, 33 bp, Artificial Sequence
  LC007 HCDR1
ggctactccatcaccagtggttattactggaac

SEQ ID NO: 71 - protein, 16 aa, Artificial Sequence
  LC007 HCDR2
YITYDGSNNYNPSLKN

SEQ ID NO: 72 - DNA, 48 bp, Artificial Sequence
  LC007 HCDR2
tacataacctacgacggtagcaataactacaacccatctctcaaaaat

SEQ ID NO: 73 - protein, 3 aa, Artificial Sequence
  LC007 HCDR3
FDY

SEQ ID NO: 74 - DNA, 9 bp, Artificial Sequence
  LC007 HCDR3
tttgactac

SEQ ID NO: 75 - protein, 112 aa, Artificial Sequence
  LC007 VH
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSS

SEQ ID NO: 76 - DNA, 336 bp, Artificial Sequence
  LC007 VH
gaggtccagctgcaggagtcaggacctggcctcgtgaaaccttctcagtctctgtctctcacctgctctgtcactggctactccatcaccagtggttattactggaactggatccggcagtttccaggaaacaagctggaatggatgggctacataacctacgacggtagcaataactacaacccatctctcaaaaatcgaatctccatcactcgtgacacatctaagaaccagtttttcctgaagttgaattctgtgactactgaggacacagctacatattactgtgcggactttgactactggggccaaggcaccactctcacagtctcctca

SEQ ID NO: 77 - protein, 11 aa, Artificial Sequence
  LC007 LCDR1
SASQGIRNYLN

SEQ ID NO: 78 - DNA, 33 bp, Artificial Sequence
  LC007 LCDR1
agtgcaagtcagggcattagaaattatttaaac

SEQ ID NO: 79 - protein, 7 aa, Artificial Sequence
  LC007 LCDR2
YTSSLHS

SEQ ID NO: 80 - DNA, 21 bp, Artificial Sequence
  LC007 LCDR2
tacacatcaagtttacactca

SEQ ID NO: 81 - protein, 9 aa, Artificial Sequence
  LC007 LCDR3
QQYSKLPWT

SEQ ID NO: 82 - DNA, 27 bp, Artificial Sequence
  LC007 LCDR3
cagcagtatagtaagcttccttggacg

SEQ ID NO: 83 - protein, 107 aa, Artificial Sequence
  LC007 VL
DIVLTQSPSSLSASLGDRVTISCSASQGIRNYLNWYQQRPDGTVKLLIYYTSSLHSGVPSRFSGSGSGTDYSLTISNLEPEDIATYYCQQYSKLPWTFGGGTKLEIK

SEQ ID NO: 84 - DNA, 321 bp, Artificial Sequence
  LC007 VL
gatattgtgctcacacagtctccatcctccctgtctgcctctctgggagacagagtcaccatcagttgcagtgcaagtcagggcattagaaattatttaaactggtatcagcagagaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaagcttccttggacgttcggtggaggcaccaagctggaaatcaaa

SEQ ID NO: 85 - protein, 5 aa, Artificial Sequence
  GA201 HCDR1
DYKIH

SEQ ID NO: 86 - DNA, 15 bp, Artificial Sequence
  GA201 HCDR1
gactacaagatacac

SEQ ID NO: 87 - protein, 17 aa, Artificial Sequence
  GA201 HCDR2
YFNPNSGYSTYAQKFQG

SEQ ID NO: 88 - DNA, 51 bp, Artificial Sequence
  GA201 HCDR2
tatttcaaccctaacagcggttatagtacctacgcacagaagttccagggc

SEQ ID NO: 89 - protein, 11 aa, Artificial Sequence
  GA201 HCDR3
LSPGGYYVMDA

SEQ ID NO: 90 - DNA, 33 bp, Artificial Sequence
  GA201 HCDR3
ctatccccaggcggttactatgttatggatgcc

SEQ ID NO: 91 - protein, 120 aa, Artificial Sequence [sequence omitted]

SEQ ID NO: 92 - DNA, 360 bp, Artificial Sequence
  GA201 VH
caggtgcagctggtgcagtctggggctgaggtgaagaagcctgggtcctcggtgaaggtctcctgcaaggcctctggtttcacattcactgactacaagatacactgggtgcgacaggcccctggacaagggctcgagtggatgggatatttcaaccctaacagcggttatagtacctacgcacagaagttccagggcagggtcaccattaccgcggacaaatccacgagcacagcctacatggagctgagcagcctgagatctgaggacacggccgtgtattactgtgcgagactatccccaggcggttactatgttatggatgcctggggccaagggaccaccgtgaccgtctcctca

SEQ ID NO: 93 - protein, 11 aa, Artificial Sequence
  GA201 LCDR1
RASQGINNYLN

SEQ ID NO: 94 - DNA, 33 bp, Artificial Sequence
  GA201 LCDR1
cgggcaagtcagggcattaacaattacttaaat

SEQ ID NO: 95 - protein, 7 aa, Artificial Sequence
  GA201 LCDR2
NTNNLQT

SEQ ID NO: 96 - DNA, 21 bp, Artificial Sequence
  GA201 LCDR2
aataccaacaacttgcagaca

SEQ ID NO: 97 - protein, 8 aa, Artificial Sequence
  GA201 LCDR3
LQHNSFPT

SEQ ID NO: 98 - DNA, 24 bp, Artificial Sequence
  GA201 LCDR3
ttgcagcataatagttttcccacg

SEQ ID NO: 99 - protein, 106 aa, Artificial Sequence [sequence omitted]

SEQ ID NO: 100 - DNA, 318 bp, Artificial Sequence
  GA201 VL
gatatccagatgacccagtctccatcctccctgtctgcatctgtcggagaccgggtcaccatcacctgccgggcaagtcagggcattaacaattacttaaattggtaccagcagaagccagggaaagcccctaagcgcctgatctataataccaacaacttgcagacaggcgtcccatcaaggttcagcggcagtggatccgggacagaattcactctcaccatcagcagcctgcagcctgaagattttgccacctattactgcttgcagcataatagttttcccacgtttggccagggcaccaagctcgagatcaag

SEQ ID NO: 101 - protein, 5 aa, Artificial Sequence
  3F2 HCDR1
SYAMS

SEQ ID NO: 102 - DNA, 15 bp, Artificial Sequence
  3F2 HCDR1
agctacgccatgagc

SEQ ID NO: 103 - protein, 16 aa, Artificial Sequence
  3F2 HCDR2
AISGSGGSTYYADSVK

SEQ ID NO: 104 - DNA, 48 bp, Artificial Sequence
  3F2 HCDR2
gccatctccggcagcggaggcagcacctactacgccgacagcgtgaag

SEQ ID NO: 105 - protein, 8 aa, Artificial Sequence
  3F2 HCDR3
YCAKGWFG

SEQ ID NO: 106 - DNA, 24 bp, Artificial Sequence
  3F2 HCDR3
tattgcgccaagggatggttcggc

SEQ ID NO: 107 - protein, 117 aa, Artificial Sequence
  3F2 VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGWFGGFNYWGQGTLVTVSS

SEQ ID NO: 108 - DNA, 351 bp, Artificial Sequence
  3F2 VH
gaggtgcagctgctggaatctggaggcggcctggtgcagcctggcggcagcctgagactgtcttgcgccgccagcggcttcaccttcagcagctacgccatgagctgggtccgacaggctcctggcaagggactggaatgggtgtccgccatctccggcagcggaggcagcacctactacgccgacagcgtgaagggccggttcaccatcagcagagacaacagcaagaacaccctgtacctgcagatgaacagcctgcgggccgaggataccgccgtgtattattgcgccaagggatggttcggcggcttcaactactggggccagggaaccctggtgacagtgtccagc

SEQ ID NO: 109 - protein, 11 aa, Artificial Sequence
  3F2 LCDR1
RASQSVTSSYL

SEQ ID NO: 110 - DNA, 33 bp, Artificial Sequence
  3F2 LCDR1
agagccagccagagcgtgaccagcagctacctg

SEQ ID NO: 111 - protein, 7 aa, Artificial Sequence
  3F2 LCDR2
NVGSRRA

SEQ ID NO: 112 - DNA, 21 bp, Artificial Sequence
  3F2 LCDR2
aacgtgggcagcagacgggcc

SEQ ID NO: 113 - protein, 9 aa, Artificial Sequence
  3F2 LCDR3
CQQGIMLPP

SEQ ID NO: 114 - DNA, 27 bp, Artificial Sequence
  3F2 LCDR3
tgccagcagggcatcatgctgcccccc

SEQ ID NO: 115 - protein, 108 aa, Artificial Sequence
  3F2 VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 116 - DNA, 324 bp, Artificial Sequence
  3F2 VL
gagatcgtgctgacccagtctcccggcaccctgagcctgagccctggcgagagagccaccctgagctgcagagccagccagagcgtgaccagcagctacctggcctggtatcagcagaagcccggccaggcccccagactgctgatcaacgtgggcagcagacgggccaccggcatccccgatagattcagcggcagcggctccggcaccgacttcaccctgaccatcagccggctggaacccgaggacttcgccgtgtactactgccagcagggcatcatgctgccccccaccttcggccagggcaccaaggtggaaatcaag

SEQ ID NO: 117 - protein, 5 aa, Artificial Sequence
  CH1A1A HCDR1
EFGMN

SEQ ID NO: 118 - DNA, 15 bp, Artificial Sequence
  CH1A1A HCDR1
gagttcggcatgaac

SEQ ID NO: 119 - protein, 17 aa, Artificial Sequence
  CH1A1A HCDR2
WINTKTGEATYVEEFKG

SEQ ID NO: 120 - DNA, 51 bp, Artificial Sequence
  CH1A1A HCDR2
tggatcaacaccaagaccggcgaggccacctacgtggaagagttcaagggc

SEQ ID NO: 121 - protein, 12 aa, Artificial Sequence
  CH1A1A HCDR3
WDFAYYVEAMDY

SEQ ID NO: 122 - DNA, 36 bp, Artificial Sequence
  CH1A1A HCDR3
tgggacttcgcctattacgtggaagccatggactac

SEQ ID NO: 123 - protein, 121 aa, Artificial Sequence
  CH1A1A VH
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSS

SEQ ID NO: 124 - DNA, 363 bp, Artificial Sequence
  CH1A1A VH
caggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagc

SEQ ID NO: 125 - protein, 11 aa, Artificial Sequence
  CH1A1A LCDR1
KASAAVGTYVA

SEQ ID NO: 126 - DNA, 33 bp, Artificial Sequence
  CH1A1A LCDR1
aaggccagtgcggctgtgggtacgtatgttgcg

SEQ ID NO: 127 - protein, 7 aa, Artificial Sequence
  CH1A1A LCDR2
SASYRKR

SEQ ID NO: 128 - DNA, 21 bp, Artificial Sequence
  CH1A1A LCDR2
tcggcatcctaccgcaaaagg

SEQ ID NO: 129 - protein, 10 aa, Artificial Sequence
  CH1A1A LCDR3
HQYYTYPLFT

SEQ ID NO: 130 - DNA, 30 bp, Artificial Sequence
  CH1A1A LCDR3
caccaatattacacctatcctctattcacg

SEQ ID NO: 131 - protein, 108 aa, Artificial Sequence
  CH1A1A VL
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIK

SEQ ID NO: 132 - DNA, 324 bp, Artificial Sequence
  CH1A1A VL
gatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaag

SEQ ID NO: 133 - protein, 10 aa, Artificial Sequence
  Anti-CD33 HCDR1
GYTITDSNIH

SEQ ID NO: 134 - DNA, 30 bp, Artificial Sequence
  Anti-CD33 HCDR1
ggctacaccatcaccgacagcaacatccac

SEQ ID NO: 135 - protein, 13 aa, Artificial Sequence
  Anti-CD33 HCDR2
YIYPYNGGTDYNQ

SEQ ID NO: 136 - DNA, 39 bp, Artificial Sequence
  Anti-CD33 HCDR2
tacatctacccctacaacggcggcaccgactacaaccag

SEQ ID NO: 137 - protein, 7 aa, Artificial Sequence
  Anti-CD33 HCDR3
GNPWLAY

SEQ ID NO: 138 - DNA, 21 bp, Artificial Sequence
  Anti-CD33 HCDR3
ggcaacccctggctggcctat

SEQ ID NO: 139 - protein, 116 aa, Artificial Sequence [sequence omitted]

SEQ ID NO: 140 - DNA, 348 bp, Artificial Sequence
  Anti-CD33 VH
gaagtgcagctggtgcagtctggcgccgaagtgaagaaacccggcagcagcgtgaaggtgtcctgcaaggccagcggctacaccatcaccgacagcaacatccactgggtccgacaggcccctgggcagagcctggaatggatcggctacatctacccctacaacggcggcaccgactacaaccagaagttcaagaaccgggccaccctgaccgtggacaaccccaccaacaccgcctacatggaactgagcagcctgcggagcgaggacaccgccttctactactgcgtgaacggcaacccctggctggcctattggggccagggaaccctggtcaccgtgtctagc

SEQ ID NO: 141 - protein, 15 aa, Artificial Sequence
  Anti-CD33 LCDR1
RASESLDNYGIRFLT

SEQ ID NO: 142 - DNA, 45 bp, Artificial Sequence
  Anti-CD33 LCDR1
cgggccagcgagagcctggacaactacggcatccggtttctgacc

SEQ ID NO: 143 - protein, 7 aa, Artificial Sequence
  Anti-CD33 LCDR2
AASNQGS

SEQ ID NO: 144 - DNA, 21 bp, Artificial Sequence
  Anti-CD33 LCDR2
gccgccagcaaccagggcagc

SEQ ID NO: 145 - protein, 9 aa, Artificial Sequence
  Anti-CD33 LCDR3
QQTKEVPWS

SEQ ID NO: 146 - DNA, 27 bp, Artificial Sequence
  Anti-CD33 LCDR3
cagcagaccaaagaggtgccctggtcc

SEQ ID NO: 147 - protein, 111 aa, Artificial Sequence [sequence omitted]

SEQ ID NO: 148 - DNA, 333 bp, Artificial Sequence
  Anti-CD33 VL
gacatccagctgacccagagccccagcaccctgtctgccagcgtgggcgacagagtgaccatcacctgtcgggccagcgagagcctggacaactacggcatccggtttctgacctggttccagcagaagcccggcaaggcccccaagctgctgatgtacgccgccagcaaccagggcagcggcgtgccaagcagattcagcggcagcggctccggcaccgagttcaccctgaccatcagcagcctgcagcccgacgacttcgccacctactactgccagcagaccaaagaggtgccctggtccttcggccagggcaccaaggtggaagtgaag

SEQ ID NO: 149 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 15 aa, Artificial Sequence
  Linker
EPKSCGGGGSGGGGS

SEQ ID NO: 151 - protein, 16 aa, Artificial Sequence
  Linker
EPKSCDGGGGSGGGGS

SEQ ID NO: 152 - protein, 32 aa, Artificial Sequence
  Linker
GGGGSGGGGSGGGGSGGGGSGGGGSGGGGSGG

SEQ ID NO: 153 - protein, 34 aa, Artificial Sequence
  Linker
SGGGSGGGSEGGGSEGGGSEGGGSEGGGSGGGSG

SEQ ID NO: 154 - protein, 19 aa, Artificial Sequence
  Leader 1
MDWTWRILFLVAAATGAHS

SEQ ID NO: 155 - DNA, 57 bp, Artificial Sequence
  Leader 1
atggactggacctggagaatcctcttcttggtggcagcagccacaggagcccactcc

SEQ ID NO: 156 - DNA, 57 bp, Artificial Sequence
  Leader 1
atggactggacctggaggatcctcttcttggtggcagcagccacaggagcccactcc

SEQ ID NO: 157 - protein, 22 aa, Artificial Sequence
  Leader 2
MDMRVPAQLLGLLLLWFPGARC

SEQ ID NO: 158 - DNA, 66 bp, Artificial Sequence
  Leader 2
atggacatgagggtccccgctcagctcctgggcctcctgctgctctggttcccaggtgccaggtgt

SEQ ID NO: 159 - protein, 19 aa, Artificial Sequence
  Leader 3
MGWSCIILFLVATATGVHS

SEQ ID NO: 160 - DNA, 57 bp, Artificial Sequence
  Leader 3
atgggatggagctgtatcatcctcttcttggtagcaacagctaccggtgtgcattcc

SEQ ID NO: 161 - DNA, 57 bp, Artificial Sequence
  Leader 3
atgggctggtcctgcatcatcctgtttctggtggctaccgccactggagtgcattcc

SEQ ID NO: 162 - DNA, 57 bp, Artificial Sequence
  Leader 3
atgggctggtcctgcatcatcctgtttctggtcgccacagccaccggcgtgcactct

SEQ ID NO: 163 - protein, 5 aa, Artificial Sequence
  V9 HCDR1
GYTMN

SEQ ID NO: 164 - DNA, 15 bp, Artificial Sequence
  V9 HCDR1
ggctacaccatgaac

SEQ ID NO: 165 - protein, 17 aa, Artificial Sequence
  V9 HCDR2
LINPYKGVSTYNQKFKD

SEQ ID NO: 166 - DNA, 51 bp, Artificial Sequence
  V9 HCDR2
ctgatcaacccctacaagggcgtgagcacctacaaccagaagttcaaggac

SEQ ID NO: 167 - protein, 13 aa, Artificial Sequence
  V9 HCDR3
SGYYGDSDWYFDV

SEQ ID NO: 168 - DNA, 39 bp, Artificial Sequence
  V9 HCDR3
agcggctactacggcgacagcgactggtacttcgacgtg

SEQ ID NO: 169 - protein, 122 aa, Artificial Sequence [sequence omitted]

SEQ ID NO: 170 - DNA, 366 bp, Artificial Sequence
  V9 VH
gaggtgcagctggtcgagtccggcggaggcctggtgcagcctggcggcagcctgagactgagctgcgccgccagcggctacagcttcaccggctacaccatgaactgggtccggcaggctcctggcaagggcctcgaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcacactggtcaccgtgtccagc

SEQ ID NO: 171 - protein, 11 aa, Artificial Sequence
  V9 LCDR1
RASQDIRNYLN

SEQ ID NO: 172 - DNA, 33 bp, Artificial Sequence
  V9 LCDR1
cgggccagccaggacatcagaaactacctgaac

SEQ ID NO: 173 - protein, 7 aa, Artificial Sequence
  V9 LCDR2
YTSRLES

SEQ ID NO: 174 - DNA, 21 bp, Artificial Sequence
  V9 LCDR2
tacacctctagactggaaagc

SEQ ID NO: 175 - protein, 9 aa, Artificial Sequence
  V9 LCDR3
QQGNTLPWT

SEQ ID NO: 176 - DNA, 27 bp, Artificial Sequence
  V9 LCDR3
cagcagggcaacacactcccctggacc

SEQ ID NO: 177 - protein, 107 aa, Artificial Sequence [sequence omitted]

SEQ ID NO: 178 - DNA, 321 bp, Artificial Sequence
  V9 VL
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaag

SEQ ID NO: 179 - protein, 454 aa, Artificial Sequence
  V9(VH-CL)-LC007(VL-CL)
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDGGGGSGGGGSDIVLTQSPSSLSASLGDRVTISCSASQGIRNYLNWYQQRPDGTVKLLIYYTSSLHSGVPSRFSGSGSGTDYSLTISNLEPEDIATYYCQQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - DNA, 1362 bp, Artificial Sequence
  V9(VH-CL)-LC007(VL-CL)
gaggtgcagctggtggaatctggcggcggactggtgcagcctggcggatctctgagactgagctgtgccgccagcggctacagcttcaccggctacaccatgaactgggtgcgccaggcccctggcaagggactggaatgggtggccctgatcaacccctacaagggcgtgtccacctacaaccagaagttcaaggaccggttcaccatcagcgtggacaagagcaagaacaccgcctacctgcagatgaacagcctgcgggccgaggacaccgccgtgtactattgtgccagaagcggctactacggcgacagcgactggtacttcgacgtgtggggccagggcacactcgtgaccgtgtcaagcgctagcgtggccgctcccagcgtgttcatcttcccacctagcgacgagcagctgaagtccggcacagcctctgtcgtgtgcctgctgaacaacttctacccccgcgaggccaaggtgcagtggaaggtggacaatgccctgcagagcggcaacagccaggaaagcgtgaccgagcaggacagcaaggatagcacctacagcctgagcagcaccctgaccctgagcaaggccgactacgagaagcacaaggtgtacgcctgcgaagtgacccaccagggcctgtctagccccgtgaccaagagcttcaaccggggcgagtgtgatggcggaggcggatccgggggaggcggctctgatattgtgctgacccagagccccagcagcctgtctgcctctctgggcgacagagtgaccatcagctgtagcgcctctcagggcatccggaactacctgaactggtatcagcagcggcccgacggcaccgtgaagctgctgatctactacaccagctccctgcactccggcgtgcccagcagattttctggcagcggctccggcaccgactactccctgaccatctccaacctggaacccgaggatatcgccacctactactgccagcagtactccaagctgccctggacctttggaggcggcaccaagctggaaatcaagcgtacggtggctgccccctccgtgtttatctttcccccatccgatgaacagctgaaaagcggcaccgccagcgtcgtgtgtctgctgaacaatttttaccctagggaagctaaagtgcagtggaaagtggataacgcactgcagtccggcaactcccaggaatctgtgacagaacaggactctaaggacagcacatactccctgtcctccaccctgacactgtctaaggctgattatgagaaacacaaagtgtatgcttgtgaagtgacacatcagggactgagcagccctgtgacaaagtccttcaacagaggcgagtgc

SEQ ID NO: 181 - protein, 227 aa, Artificial Sequence
  Fc(knob) P329G LALA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - DNA, 681 bp, Artificial Sequence
  Fc(knob) P329G LALA
gacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 183 - protein, 212 aa, Artificial Sequence
  V9(VL-CH1)
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 184 - DNA, 636 bp, Artificial Sequence
  V9(VL-CH1)
gatattcagatgacccagagccccagctctctgagcgccagcgtgggcgacagagtgaccatcacctgtcgggccagccaggacatcagaaactacctgaactggtatcagcagaagcccggcaaggcccccaagctgctgatctactacaccagcagactggaaagcggcgtgccctccagattttccggcagcggctccggcaccgactacaccctgaccatcagcagcctgcagcccgaggatttcgccacatattactgccagcagggcaataccctgccctggaccttcggacagggcacaaaagtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 185 - protein, 456 aa, Artificial Sequence
  V9(VH-CL)-Fc(knob) P329G LALA
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - DNA, 1368 bp, Artificial Sequence
  V9(VH-CL)-Fc(knob) P329G LALA
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 187 - protein, 682 aa, Artificial Sequence
  LC007(VH-CH1)-V9(VH-CL)-Fc(knob) P329G LALA
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - DNA, 2046 bp, Artificial Sequence
  LC007(VH-CH1)- V9(VH-CL)-Fc(knob) P329G LALA
gaggtgcagctgcaggaatctggccctggcctggtcaagccaagccagagtctgagcctgacctgcagcgtgaccggctacagcattaccagcggctactactggaactggattcggcagttccccggcaataagctggaatggatgggctacatcacctacgacggcagcaacaactacaaccccagcctgaagaaccggatcagcatcacccgggacaccagcaagaaccagttcttcctgaagctgaacagcgtgaccaccgaggacaccgccacatactattgcgccgacttcgactactggggccagggcaccaccctgaccgtgtccagcgccagcacaaagggccctagcgtgttccctctggcccccagcagcaagagcacaagcggcggaacagccgccctgggctgcctcgtgaaggactacttccccgagcccgtgacagtgtcttggaacagcggagccctgacaagcggcgtgcacaccttccctgccgtgctgcagagcagcggcctgtactccctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggaggatccgaagtgcagctggtggaatctggcggaggcctggtgcagcctggcggatctctgagactgagctgtgccgccagcggctacagcttcaccggctacaccatgaactgggtgcgccaggcccctggcaagggactggaatgggtggccctgatcaacccctacaagggcgtgtccacatacaaccagaagttcaaggaccggttcaccatcagcgtggacaagagcaagaacaccgcctacctgcagatgaacagcctgcgggccgaggacaccgccgtgtactattgtgccagaagcggctactacggcgacagcgactggtacttcgacgtgtggggccagggcacactcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 189 - protein, 214 aa, Artificial Sequence
  M4-3 ML2(VL-CL)
DIQMTQSPSSLSASVGDRVTITCRASQGIRNYLNWYQQKPGKAPKLLIYYTSSLHSGVPSRFSGSGSGTDFTLTISSLQPEDFATYYCQQYSKLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 190 - DNA, 642 bp, Artificial Sequence
  M4-3 ML2(VL-CL)
gacatccagatgacccagagccccagcagcctgagcgccagcgtgggcgacagagtgaccatcacctgccgggccagccagggcatccggaactacctgaactggtatcagcagaagcccggcaaggcccccaagctgctgatctactacaccagcagcctgcacagcggcgtgcctagccggtttagcggcagcggctccggcaccgacttcaccctgaccattagctccctgcagcccgaggacttcgccacctactactgccagcagtacagcaagctgccctggaccttcggccagggaacaaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 191 - protein, 664 aa, Artificial Sequence
  V9(VL-CH1)-M4-3 ML2(VH-CH1)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - DNA, 1992 bp, Artificial Sequence
  V9(VL-CH1)-M4-3 ML2(VH-CH1)-Fc(knob) P329G LALA (DNA)
gatatccagatgacccagagccccagctctctgagcgccagcgtgggcgacagagtgaccatcacctgtcgggccagccaggacatcagaaactacctgaactggtatcagcagaagcccggcaaggcccccaagctgctgatctactacaccagcagactggaaagcggcgtgccctccagattttccggcagcggctccggcaccgactacaccctgaccatcagcagcctgcagcccgaggatttcgccacatattactgccagcagggcaataccctgccctggaccttcggacagggcacaaaagtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggagggggatctcaggtgcagctgcaggaaagcggccctggcctggtcaagcccagccagaccctgagcctgacctgcaccgtgtccggcggcagcatcaccagcggctactactggaactggattcggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 193 - protein, 442 aa, Artificial Sequence
  M4-3 ML2(VH-CH1)-Fc(hole) P329G LALA
QVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 194 - DNA, 1326 bp, Artificial Sequence
  M4-3 ML2(VH-CH1)-Fc(hole) P329G LALA
caggtgcagctgcaggaaagcggccctggcctggtcaagcccagccagaccctgagcctgacctgcaccgtgtccggcggcagcatcaccagcggctactactggaactggatccggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 195 - protein, 681 aa, Artificial Sequence
  V9(VH-CL)-M4-3 ML2(VH-CH1)-Fc(knob) P329G LALA
EVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSQVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - DNA, 2043 bp, Artificial Sequence
  V9(VH-CL)-M4-3 ML2(VH-CH1)-Fc(knob) P329G LALA (DNA)
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagcgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggcggaggcggatccggcggagggggatctcaggtgcagctgcaggaaagcggccctggcctggtcaagcccagccagaccctgagcctgacctgcaccgtgtccggcggcagcatcaccagcggctactactggaactggattcggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 197 - protein, 690 aa, Artificial Sequence
  CH1A1A(VH-CH1)- V9(VH-CL)-Fc(knob) P329G LALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - DNA, 2070 bp, Artificial Sequence
  CH1A1A(VH-CH1)-V9(VH-CL)-Fc(knob) P329G LALA
caggtgcagctggtgcagtctggcgccgaagtgaagaaacctggcgccagcgtgaaggtgtcctgcaaggccagcggctacaccttcaccgagttcggcatgaactgggtccgacaggcccctggacagggcctggaatggatgggctggatcaacaccaagaccggcgaggccacctacgtggaagagttcaagggcagagtgaccttcaccaccgacaccagcaccagcaccgcctacatggaactgcggagcctgagaagcgacgacaccgccgtgtactactgcgccagatgggacttcgcctactatgtggaagccatggactactggggccagggcaccaccgtgaccgtgtctagtgctagcacaaagggccccagcgtgttccctctggcccctagcagcaagagcacatctggcggaacagccgccctgggctgcctggtcaaggactactttcccgagcccgtgacagtgtcctggaactctggcgccctgacaagcggcgtgcacacctttccagccgtgctgcagagcagcggcctgtactctctgagcagcgtggtcaccgtgcctagctctagcctgggcacccagacctacatctgcaacgtgaaccacaagcccagcaacaccaaggtggacaagaaggtggaacccaagagctgcggcggaggcggatccggaggcggaggatccgaagtgcagctggtggaatctggcggaggcctggtgcagcctggcggatctctgagactgagctgtgccgccagcggctacagcttcaccggctacaccatgaactgggtgcgccaggcccctggcaagggactggaatgggtggccctgatcaacccctacaagggcgtgtccacatacaaccagaagttcaaggaccggttcaccatcagcgtggacaagagcaagaacaccgcctacctgcagatgaacagcctgcgggccgaggacaccgccgtgtactattgtgccagaagcggctactacggcgacagcgactggtacttcgacgtgtggggccagggcacactcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 199 - protein, 214 aa, Artificial Sequence
  H2C(VL-CH1)
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 200 - DNA, 642 bp, Artificial Sequence
  H2C(VL-CH1)
cagaccgtggtgacacaggaacccagcctgaccgtctcccctggcggcaccgtgaccctgacctgtggaagcagcacaggcgccgtgaccagcggctactaccccaactgggtgcagcagaagcccggccaggcccctagaggactgatcggcggcaccaagtttctggcccctggcacccccgccagattctctggctctctgctgggcggcaaggccgccctgacactgtctggcgtgcagcctgaggacgaggccgagtactactgcgccctgtggtacagcaacagatgggtgttcggcggaggcaccaagctgaccgtgctgagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 201 - protein, 684 aa, Artificial Sequence
  H2C(VH-CL)-M4-3 ML2(VH-CH1)-Fc(knob) P329G LALA
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSQVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - DNA, 2052 bp, Artificial Sequence
  H2C(VH-CL)-M4-3 ML2(VH-CH1)-Fc(knob) P329G LALA
gaggtgcagctggtggaaagcggcggaggactggtgcagcctggcggaagcctgaagctgtcttgcgccgccagcggcttcaccttcaacaaatacgccatgaactgggtgcgccaggcccctggcaagggactggaatgggtggcccggatcagaagcaagtacaacaactacgccacctactacgccgacagcgtgaaggaccggttcaccatcagccgggacgacagcaagaacaccgcctacctgcagatgaacaacctgaaaaccgaggacaccgccgtgtactactgcgtgcggcacggcaacttcggcaacagctacatcagctactgggcctactggggacagggcaccctggtgacagtgtccagcgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggcggaggcggatccggcggagggggatctcaggtgcagctgcaggaaagcggccctggcctggtcaagcccagccagaccctgagcctgacctgcaccgtgtccggcggcagcatcaccagcggctactactggaactggattcggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 203 - protein, 212 aa, Artificial Sequence
  431/26(VL-CL)
DIQMTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - DNA, 636 bp, Artificial Sequence
  431/26(VL-CL)
gacatccagatgacccagagccccagcagcctgtctgccagcgtgggcgacagagtgaccatcacctgtagcaccagcagcagcgtgtcctacatgcactggtatcagcagaagcccggcaaggcccccaagctgctgatctacagcacctccaatctggccagcggcgtgcccagcagattttctggcagcggctccggcaccgacttcaccttcaccatcagctccctgcagcccgaggatatcgccacctactactgccaccagtggtccagctaccccacctttggccagggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 205 - protein, 689 aa, Artificial Sequence
  431/26(VH-CH1)-V9(VH-CL)-Fc(knob) P329G LALA
QVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - DNA, 2067 bp, Artificial Sequence
  431/26(VH-CH1)-V9(VH-CL)-Fc(knob) P329G LALA
caggtgcagctgcaggaatctggccctggactcgtgcggcctagccagacactgagcctgacctgtaccgtgtccggcttcaccatcagcagcggctacagctggcattgggtgcgccagccacctggcagaggcctggaatggatcggctacatccagtacagcggcatcaccaactacaaccccagcctgaagtccagagtgaccatgctggtggacacctccaagaaccagttcagcctgcggctgagcagcgtgacagccgccgatacagccgtgtactactgcgccagagaggactacgactaccactggtacttcgacgtgtggggccagggctctctcgtgaccgtgtcaagcgctagcacaaagggccccagcgtgttccctctggcccctagcagcaagagcacatctggcggaacagccgccctgggctgcctggtcaaggactactttcccgagcccgtgacagtgtcctggaactctggcgccctgacaagcggcgtgcacacctttccagccgtgctgcagagcagcggcctgtactctctgagcagcgtggtcaccgtgcctagctctagcctgggcacccagacctacatctgcaacgtgaaccacaagcccagcaacaccaaggtggacaagaaggtggaacccaagagctgcggcggaggcggatccggaggcggaggatccgaagtgcagctggtggaatctggcggaggcctggtgcagcctggcggatctctgagactgagctgtgccgccagcggctacagcttcaccggctacaccatgaactgggtgcgccaggcccctggcaagggactggaatgggtggccctgatcaacccctacaagggcgtgtccacatacaaccagaagttcaaggaccggttcaccatcagcgtggacaagagcaagaacaccgcctacctgcagatgaacagcctgcgggccgaggacaccgccgtgtactattgtgccagaagcggctactacggcgacagcgactggtacttcgacgtgtggggccagggcacactcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 207 - protein, 450 aa, Artificial Sequence
  431/26(VH-CH1)-Fc(hole) P329G LALA
QVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 208 - DNA, 1350 bp, Artificial Sequence
  431/26(VH-CH1)-Fc(hole) P329G LALA
caggtgcagctgcaggaatctggccctggactcgtgcggcctagccagacactgagcctgacctgtaccgtgtccggcttcaccatcagcagcggctacagctggcattgggtgcgccagccacctggcagaggcctggaatggatcggctacatccagtacagcggcatcaccaactacaaccccagcctgaagtccagagtgaccatgctggtggacacctccaagaaccagttcagcctgcggctgagcagcgtgacagccgccgatacagccgtgtactactgcgccagagaggactacgactaccactggtacttcgacgtgtggggccagggctctctcgtgaccgtgtcaagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 209 - protein, 464 aa, Artificial Sequence
  CH1A1A(VL-CL)-V9 (VH-CL)
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 210 - DNA, 1392 bp, Artificial Sequence
  CH1A1A(VL-CL)-V9 (VH-CL)
gatatccagatgacccagagccccagcagcctgtctgccagcgtgggcgacagagtgaccatcacatgcaaggcctctgccgccgtgggcacatacgtggcctggtatcagcagaagcccggcaaggcccccaagctgctgatctacagcgccagctaccggaagagaggcgtgcccagcagattttccggcagcggctctggcaccgacttcaccctgaccatcagctccctgcagcccgaggacttcgccacctactactgccaccagtactacacctaccccctgttcaccttcggccagggcaccaagctcgagatcaagcgtacggtggccgctcccagcgtgttcatcttcccacctagcgacgagcagctgaagtccggcacagcctctgtcgtgtgcctgctgaacaacttctacccccgcgaggccaaggtgcagtggaaggtggacaatgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgaatgtggcggcggaggatccggcggaggcggctccggaggcggaggaagtggcggagggggatctgaagtgcagctggtggaatctggcggaggcctggtgcagcctggcggatctctgagactgagctgtgccgccagcggctacagcttcaccggctacaccatgaactgggtgcgccaggcccctggcaagggactggaatgggtggccctgatcaacccctacaagggcgtgtccacatacaaccagaagttcaaggaccggttcaccatcagcgtggacaagagcaagaacaccgcctacctgcagatgaacagcctgcgggccgaggacaccgccgtgtactactgtgccagaagcggctactacggcgacagcgactggtacttcgacgtgtggggccagggaaccctcgtgaccgtgtcaagcgctagcgtggccgcaccctctgtgtttatctttccaccctctgacgaacagctgaaaagcggcaccgccagcgtcgtgtgtctgctgaacaatttttaccctagggaagctaaagtgcagtggaaagtggataacgcactgcagtccggcaactcccaggaatctgtgacagaacaggactccaaggacagcacatactccctgtccagcacactgaccctgtctaaggccgattatgagaaacacaaagtgtatgcttgtgaagtgacacatcagggactgagcagccctgtgacaaagtccttcaacagaggcgagtgt

SEQ ID NO: 211 - protein, 451 aa, Artificial Sequence
  CH1A1A(VH-CH1)-Fc(knob) P329G LALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - DNA, 1353 bp, Artificial Sequence
  CH1A1A(VH-CH1)-Fc(knob) P329G LALA
caggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 213 - protein, 227 aa, Artificial Sequence
  Fc(hole) P329G LALA
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 214 - DNA, 681 bp, Artificial Sequence
  Fc(hole) P329G LALA
gacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 215 - protein, 214 aa, Artificial Sequence
  CH2527(VL-CH1)
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 216 - DNA, 642 bp, Artificial Sequence
  CH2527(VL-CH1)
caggccgtcgtgacccaggaaagcgccctgacaacaagccctggcgagacagtgaccctgacctgcagatctagcacaggcgccgtgaccaccagcaactacgccaactgggtgcaggaaaagcccgaccacctgttcaccggcctgatcggcggcaccaacaaaagggctccaggcgtgccagccagattcagcggcagcctgattggcgataaggccgccctgaccatcactggcgcccagacagaggacgaggccatctacttttgcgccctgtggtacagcaacctgtgggtgttcggcggaggcaccaagctgacagtgctgagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgt

SEQ ID NO: 217 - protein, 684 aa, Artificial Sequence
  CH2527(VH-CL)-LC007(VH-CH1)-Fc(knob) P329G LALA
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSEVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - DNA, 2052 bp, Artificial Sequence
  CH2527(VH-CL)-LC007(VH-CH1)-Fc(knob) P329G LALA
gaagtgcagctggtggaaagcggcggaggcctggtgcagcctaagggctctctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggaccggttcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgctgctagcgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggcggaggcggatccggcggagggggatctgaggtccagctgcaggagtcaggacctggcctcgtgaaaccttctcagtctctgtctctcacctgctctgtcactggctactccatcaccagtggttattactggaactggattcggcagtttccaggaaacaagctggaatggatgggctacataacctacgacggtagcaataactacaacccatctctcaaaaatcgaatctccattactcgtgacacatctaagaaccagtttttcctgaagttgaattctgtgactactgaggacacagctacatattactgtgcggactttgactactggggccaaggcaccactctcacagtctccagcgctagcaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 685 aa, Artificial Sequence
  LC007(VH-CH1)-CH2527(VH-CL)-Fc(knob) P329G LALA
EVQLQESGPGLVKPSQSLSLTCSVTGYSITSGYYWNWIRQFPGNKLEWMGYITYDGSNNYNPSLKNRISITRDTSKNQFFLKLNSVTTEDTATYYCADFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - DNA, 2055 bp, Artificial Sequence
  LC007(VH-CH1)-CH2527(VH-CL)-Fc(knob) P329G LALA
gaggtgcagctgcaggaatctggccctggcctggtcaagccaagccagagtctgagcctgacctgcagcgtgaccggctacagcattaccagcggctactactggaactggattcggcagttccccggcaataagctggaatggatgggctacatcacctacgacggcagcaacaactacaaccccagcctgaagaaccggatcagcatcacccgggacaccagcaagaaccagttcttcctgaagctgaacagcgtgaccaccgaggacaccgccacatactattgcgccgacttcgactactggggccagggcaccaccctgaccgtgtccagcgccagcacaaagggccctagcgtgttccctctggcccccagcagcaagagcacaagcggcggaacagccgccctgggctgcctcgtgaaggactacttccccgagcccgtgacagtgtcttggaacagcggagccctgacaagcggcgtgcacaccttccctgccgtgctgcagagcagcggcctgtactccctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggaggatccgaagtgcagctggtggaaagcggcggaggcctggtgcagcctaagggctctctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggaccggttcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgctgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - protein, 218 aa, Artificial Sequence
  anti-CD33(VL-CL)
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 654 bp, Artificial Sequence
  anti-CD33(VL-CL)
gacatccagatgacccagagccccagcagcctgagcgccagcgtgggcgacagagtgaccatcacctgtcgggccagcgagagcgtggacaactacggcatcagcttcatgaactggttccagcagaagcccggcaaggcccccaagctgctgatctacgccgccagcaatcagggcagcggcgtgcccagcagattcagcggctctggcagcggcaccgacttcaccctgaccatcagcagcctgcagcccgacgacttcgccacctactactgccagcagagcaaagaggtgccctggaccttcggccagggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 668 aa, Artificial Sequence
  V9(VL-CH1)-anti-CD33(VH-CH1)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - DNA, 2004 bp, Artificial Sequence
  V9(VL-CH1)-anti-CD33(VH-CH1)-Fc(knob) P329G LALA
gatatccagatgacccagagccccagctctctgagcgccagcgtgggcgacagagtgaccatcacctgtcgggccagccaggacatcagaaactacctgaactggtatcagcagaagcccggcaaggcccccaagctgctgatctactacaccagcagactggaaagcggcgtgccctccagattttccggcagcggctccggcaccgactacaccctgaccatcagcagcctgcagcccgaggatttcgccacatattactgccagcagggcaataccctgccctggaccttcggacagggcacaaaagtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggaggcggatctcaggtgcagctggtgcagtctggcgccgaagtgaagaaacccggcagcagcgtgaaggtgtcctgcaaggccagcggctacaccttcaccgactacaacatgcactgggtccgccaggccccaggccagggactggaatggatcggctacatctacccctacaacggcggcaccggctacaaccagaagttcaagagcaaggccaccatcaccgccgacgagagcaccaacaccgcctacatggaactgagcagcctgcggagcgaggacaccgccgtgtactactgcgccagaggcagacccgccatggactactggggccagggcaccctggtgacagtgtccagcgccagcacaaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 225 - protein, 446 aa, Artificial Sequence
  anti-CD33(VH-CH1)-Fc(hole) P329G LALA
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 226 - DNA, 1338 bp, Artificial Sequence
  anti-CD33(VH-CH1)-Fc(hole) P329G LALA
caggtgcagctggtgcagtctggcgccgaagtgaagaaacccggcagcagcgtgaaggtgtcctgcaaggccagcggctacaccttcaccgactacaacatgcactgggtccgccaggccccaggccagggactggaatggatcggctacatctacccctacaacggcggcaccggctacaaccagaagttcaagagcaaggccaccatcaccgccgacgagagcaccaacaccgcctacatggaactgagcagcctgcggagcgaggacaccgccgtgtactactgcgccagaggcagacccgccatggactactggggccagggcaccctggtgacagtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 219 aa, Artificial Sequence
  anti-CD20(VL-CL)
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - DNA, 657 bp, Artificial Sequence
  anti-CD20(VL-CL)
gatatcgtgatgacccagactccactctccctgcccgtcacccctggagagcccgccagcattagctgcaggtctagcaagagcctcttgcacagcaatggcatcacttatttgtattggtacctgcaaaagccagggcagtctccacagctcctgatttatcaaatgtccaaccttgtctctggcgtccctgaccggttctccggatccgggtcaggcactgatttcacactgaaaatcagcagggtggaggctgaggatgttggagtttattactgcgctcagaatctagaacttccttacaccttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 229 - protein, 671 aa, Artificial Sequence
  V9(VL-CH1)-anti-CD20(VH-CH1)-Fc(knob) P329G LALA
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - DNA, 2013 bp, Artificial Sequence
  V9(VL-CH1)-anti-CD20(VH-CH1)-Fc(knob) P329G LALA
gatatccagatgacccagagccccagctctctgagcgccagcgtgggcgacagagtgaccatcacctgtcgggccagccaggacatcagaaactacctgaactggtatcagcagaagcccggcaaggcccccaagctgctgatctactacaccagcagactggaaagcggcgtgccctccagattttccggcagcggctccggcaccgactacaccctgaccatcagcagcctgcagcccgaggatttcgccacatattactgccagcagggcaataccctgccctggaccttcggacagggcacaaaagtggaaatcaagagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgtggcggaggcggatccggcggagggggatctcaggtgcaattggtgcagtctggcgctgaagttaagaagcctgggagttcagtgaaggtctcctgcaaggcttccggatacgccttcagctattcttggatcaattgggtgcggcaggcgcctggacaagggctcgagtggatgggacggatctttcccggcgatggggatactgactacaatgggaaattcaagggcagagtcacaattaccgccgacaaatccactagcacagcctatatggagctgagcagcctgagatctgaggacacggccgtgtattactgtgcaagaaatgtctttgatggttactggcttgtttactggggccagggaaccctggtcaccgtctcctcagctagcaccaagggccccagcgtgttccccctggcacccagcagcaagagcacatctggcggaacagccgctctgggctgtctggtgaaagactacttccccgagcccgtgaccgtgtcttggaactctggcgccctgaccagcggcgtgcacacctttccagccgtgctgcagagcagcggcctgtactccctgtcctccgtggtcaccgtgccctctagctccctgggaacacagacatatatctgtaatgtcaatcacaagccttccaacaccaaagtcgataagaaagtcgagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 231 - protein, 449 aa, Artificial Sequence
  anti-CD20(VH-CH1)-Fc(hole) P329G LALA
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 232 - DNA, 1347 bp, Artificial Sequence
  anti-CD20(VH-CH1)-Fc(hole) P329G LALA
caggtgcaattggtgcagtctggcgctgaagttaagaagcctgggagttcagtgaaggtctcctgcaaggcttccggatacgccttcagctattcttggatcaattgggtgcggcaggcgcctggacaagggctcgagtggatgggacggatctttcccggcgatggggatactgactacaatgggaaattcaagggcagagtcacaattaccgccgacaaatccactagcacagcctatatggagctgagcagcctgagatctgaggacacggccgtgtattactgtgcaagaaatgtctttgatggttactggcttgtttactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 233 - protein, 11 aa, Artificial Sequence
  M4-3 ML2 HCDR1
GGSITSGYYWN

SEQ ID NO: 234 - DNA, 33 bp, Artificial Sequence
  M4-3 ML2 HCDR1
ggcggcagcatcaccagcggctactactggaac

SEQ ID NO: 235 - protein, 16 aa, Artificial Sequence
  M4-3 ML2 HCDR2
YITYDGSNNYNPSLKS

SEQ ID NO: 236 - DNA, 48 bp, Artificial Sequence
  M4-3 ML2 HCDR2
tacatcacctacgacggcagcaacaactacaaccccagcctgaagtcc

SEQ ID NO: 237 - protein, 3 aa, Artificial Sequence
  M4-3 ML2 HCDR3
FDY

SEQ ID NO: 238 - DNA, 9 bp, Artificial Sequence
  M4-3 ML2 HCDR3
ttcgactac

SEQ ID NO: 239 - protein, 112 aa, Artificial Sequence
  M4-3 ML2 VH
QVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSS

SEQ ID NO: 240 - DNA, 336 bp, Artificial Sequence
  M4-3 ML2 VH
caggtgcagctgcaggaaagcggccctggcctggtcaagcccagccagaccctgagcctgacctgcaccgtgtccggcggcagcatcaccagcggctactactggaactggatccggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagc

SEQ ID NO: 241 - protein, 11 aa, Artificial Sequence
  M4-3 ML2 LCDR1
RASQGIRNYLN

SEQ ID NO: 242 - DNA, 33 bp, Artificial Sequence
  M4-3 ML2 LCDR1
cgggccagccagggcatccggaactacctgaac

SEQ ID NO: 243 - protein, 7 aa, Artificial Sequence
  M4-3 ML2 LCDR2
YTSSLHS

SEQ ID NO: 244 - DNA, 21 bp, Artificial Sequence
  M4-3 ML2 LCDR2
tacaccagcagcctgcacagc

SEQ ID NO: 245 - protein, 9 aa, Artificial Sequence
  M4-3 ML2 LCDR3
QQYSKLPWT

SEQ ID NO: 246 - DNA, 27 bp, Artificial Sequence
  M4-3 ML2 LCDR3
cagcagtacagcaagctgccctggacc

SEQ ID NO: 247 - protein, 107 aa, Artificial Sequence
  M4-3 ML2 VL
DIQMTQSPSSLSASVGDRVTITCRASQGIRNYLNWYQQKPGKAPKLLIYYTSSLHSGVPSRFSGSGSGTDFTLTISSLQPEDFATYYCQQYSKLPWTFGQGTKVEIK

SEQ ID NO: 248 - DNA, 321 bp, Artificial Sequence
  M4-3 ML2 VL
gacatccagatgacccagagccccagcagcctgagcgccagcgtgggcgacagagtgaccatcacctgccgggccagccagggcatccggaactacctgaactggtatcagcagaagcccggcaaggcccccaagctgctgatctactacaccagcagcctgcacagcggcgtgcctagccggtttagcggcagcggctccggcaccgacttcaccctgaccattagctccctgcagcccgaggacttcgccacctactactgccagcagtacagcaagctgccctggaccttcggccagggaacaaaggtggagatcaag

SEQ ID NO: 249 - protein, 5 aa, Artificial Sequence
  anti-CD3 HCDR1
TYAMN

SEQ ID NO: 250 - DNA, 15 bp, Artificial Sequence
  anti-CD3 HCDR1
acctacgccatgaac

SEQ ID NO: 251 - protein, 19 aa, Artificial Sequence
  anti-CD3 HCDR2
RIRSKYNNYATYYADSVKD

SEQ ID NO: 252 - DNA, 57 bp, Artificial Sequence
  anti-CD3 HCDR2
cggatcagaagcaagtacaacaattacgccacctactacgccgacagcgtgaaggac

SEQ ID NO: 253 - protein, 14 aa, Artificial Sequence
  anti-CD3 HCDR3
HGNFGNSYVSWFAY

SEQ ID NO: 254 - DNA, 42 bp, Artificial Sequence
  anti-CD3 HCDR3
cacggcaacttcggcaacagctatgtgtcttggtttgcctac

SEQ ID NO: 255 - protein, 125 aa, Artificial Sequence
  anti-CD3 VH
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 256 - DNA, 375 bp, Artificial Sequence
  anti-CD3 VH
gaagtgcagctggtggaaagcggcggaggcctggtgcagcctaagggctctctgaagctgagctgtgccgccagcggcttcaccttcaacacctacgccatgaactgggtgcgccaggcccctggcaaaggcctggaatgggtggcccggatcagaagcaagtacaacaattacgccacctactacgccgacagcgtgaaggaccggttcaccatcagccgggacgacagccagagcatcctgtacctgcagatgaacaacctgaaaaccgaggacaccgccatgtactactgcgtgcggcacggcaacttcggcaacagctatgtgtcttggtttgcctactggggccagggcaccctcgtgacagtgtctgct

SEQ ID NO: 257 - protein, 14 aa, Artificial Sequence
  anti-CD3 LCDR1
RSSTGAVTTSNYAN

SEQ ID NO: 258 - DNA, 42 bp, Artificial Sequence
  anti-CD3 LCDR1
agatctagcacaggcgccgtgaccaccagcaactacgccaac

SEQ ID NO: 259 - protein, 7 aa, Artificial Sequence
  anti-CD3 LCDR2
GTNKRAP

SEQ ID NO: 260 - DNA, 21 bp, Artificial Sequence
  anti-CD3 LCDR2
ggcaccaacaaaagggctcca

SEQ ID NO: 261 - protein, 9 aa, Artificial Sequence
  anti-CD3 LCDR3
ALWYSNLWV

SEQ ID NO: 262 - DNA, 27 bp, Artificial Sequence
  anti-CD3 LCDR3
gccctgtggtacagcaacctgtgggtg

SEQ ID NO: 263 - protein, 109 aa, Artificial Sequence
  anti-CD3 VL
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 264 - DNA, 327 bp, Artificial Sequence
  anti-CD3 VL
caggccgtcgtgacccaggaaagcgccctgacaacaagccctggcgagacagtgaccctgacctgcagatctagcacaggcgccgtgaccaccagcaactacgccaactgggtgcaggaaaagcccgaccacctgttcaccggcctgatcggcggcaccaacaaaagggctccaggcgtgccagccagattcagcggcagcctgattggcgataaggccgccctgaccatcactggcgcccagacagaggacgaggccatctacttttgcgccctgtggtacagcaacctgtgggtgttcggcggaggcaccaagctgacagtgctg

SEQ ID NO: 265 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 266 - protein, 198 aa, Macaca fascicularis
MQSGTRWRVLGLCLLSIGVWGQDGNEEMGSITQTPYQVSISGTTVILTCSQHLGSEAQWQHNGKNKEDSGDRLFLPEFSEMEQSGYYVCYPRGSNPEDASHHLYLKARVCENCMEMDVMAVATIVIVDICITLGLLLLVYYWSKNRKAKAKPVTRGAGAGGRQRGQNKERPPPVPNPDYEPIRKGQQDLYSGLNQRRI

SEQ ID NO: 267 - protein, 455 aa, Artificial Sequence
  Heavy chain "CD3 CH2527 (VH_3-23(12))"
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 215 aa, Artificial Sequence
  Light chain "CD3 CH2527 (VL_7-46(13))"
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 269 - protein, 125 aa, Artificial Sequence
  VH "CD3 CH2527 (VH_3-23(12))"
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSS

SEQ ID NO: 270 - protein, 5 aa, Artificial Sequence
  VH CDR H1 "CD3 CH2527 (VH_3-23(12))"
TYAMN

SEQ ID NO: 271 - protein, 19 aa, Artificial Sequence
  VH CDR H2 "CD3 CH2527 (VH_3-23(12))"
RIRSKYNNYATYYADSVKG

SEQ ID NO: 272 - protein, 14 aa, Artificial Sequence
  VH CDR H3 "CD3 CH2527 (VH_3-23(12))"
HGNFGNSYVSWFAY

SEQ ID NO: 273 - protein, 109 aa, Artificial Sequence
  VL "CD3 CH2527 (VL_7-46(13))"
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVL

SEQ ID NO: 274 - protein, 14 aa, Artificial Sequence
  VL CDR L1 "CD3 CH2527 (VL_7-46(13))"
GSSTGAVTTSNYAN

SEQ ID NO: 275 - protein, 7 aa, Artificial Sequence
  VL CDR L2 "CD3 CH2527 (VL_7-46(13))"
GTNKRAP

SEQ ID NO: 276 - protein, 9 aa, Artificial Sequence
  VL CDR L3 "CD3 CH2527 (VL_7-46(13))"
ALWYSNLWV

SEQ ID NO: 277 - protein, 442 aa, Artificial Sequence
  Heavy chain "MCSP M4-3 (C1)"
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 214 aa, Artificial Sequence
  Light chain "MCSP ML2 (G3) "
DIQMTQSPSSLSASVGDRVTITCRASQGIRNYLNWYQQKPGKAPKLLIYYTSSLHSGVPSRFSGSGSGTDYTLTISSLQPEDFATYYCQQYSALPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 279 - protein, 112 aa, Artificial Sequence
  VH " MCSP M4-3 (C1)"
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSS

SEQ ID NO: 280 - protein, 6 aa, Artificial Sequence
  VH CDR H1 " MCSP M4-3 (C1)"
SGYYWN

SEQ ID NO: 281 - protein, 16 aa, Artificial Sequence
  VH CDR H2 " MCSP M4-3 (C1)"
YITFDGSNNYNPSLKS

SEQ ID NO: 282 - protein, 3 aa, Artificial Sequence
  VH CDR H3 " MCSP M4-3 (C1)"
FDY

SEQ ID NO: 283 - protein, 107 aa, Artificial Sequence
  VL "MCSP ML2 (G3) "
DIQMTQSPSSLSASVGDRVTITCRASQGIRNYLNWYQQKPGKAPKLLIYYTSSLHSGVPSRFSGSGSGTDYTLTISSLQPEDFATYYCQQYSALPWTFGQGTKVEIK

SEQ ID NO: 284 - protein, 11 aa, Artificial Sequence
  VL CDR L1 "MCSP ML2 (G3) "
RASQGIRNYLN

SEQ ID NO: 285 - protein, 7 aa, Artificial Sequence
  VL CDR L2 "MCSP ML2 (G3) "
YTSSLHS

SEQ ID NO: 286 - protein, 9 aa, Artificial Sequence
  VL CDR L3 "MCSP ML2 (G3) "
QQYSALPWT

SEQ ID NO: 287 - protein, 451 aa, Artificial Sequence
  Heavy chain "CEA CH1A1A 98-99"
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 215 aa, Artificial Sequence; identical to SEQ ID NO: 67
  Light chain "CEA 2F1"

SEQ ID NO: 289 - protein, 121 aa, Artificial Sequence; identical to SEQ ID NO: 123
  VH "CEA CH1A1A 98-99"

SEQ ID NO: 290 - protein, 5 aa, Artificial Sequence
  VH CDR H1 "CEA CH1A1A 98-99"
EFGMN

SEQ ID NO: 291 - protein, 17 aa, Artificial Sequence
  VH CDR H2 "CEA CH1A1A 98-99"
WINTKTGEATYVEEFKG

SEQ ID NO: 292 - protein, 12 aa, Artificial Sequence
  VH CDR H3 "CEA CH1A1A 98-99"
WDFAYYVEAMDY

SEQ ID NO: 293 - protein, 108 aa, Artificial Sequence; identical to SEQ ID NO: 131
  VL "CEA 2F1"

SEQ ID NO: 294 - protein, 11 aa, Artificial Sequence
  VL CDR L1 "CEA 2F1"
KASAAVGTYVA

SEQ ID NO: 295 - protein, 7 aa, Artificial Sequence
  VL CDR L2 "CEA 2F1"
SASYRKR

SEQ ID NO: 296 - protein, 10 aa, Artificial Sequence
  VL CDR L3 "CEA 2F1"
HQYYTYPLFT

SEQ ID NO: 297 - protein, 111 aa, Artificial Sequence
  VL "CD3 CH2527 (VL_7-43(11))"
QTVVTQEPSLTVSPGGTVTLTCGSSTGAVTTSNYANWVQQKPGQAPRGLIGGTNKRAPGTPARFSGSLLGGKAALTLSGVQPEDEAEYYCALWYSNLWVFGGGTKLTVLSS

SEQ ID NO: 298 - protein, 125 aa, Artificial Sequence
  VH "CD3 CH2527 (VHcomboA49SV93A)"
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCARHGNFGNSYVSWFAYWGQGTLVTVSS

SEQ ID NO: 299 - protein, 125 aa, Artificial Sequence
  VH "CD3 CH2527 (VHcomboA49SV93AR94K)"
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCAKHGNFGNSYVSWFAYWGQGTLVTVSS

SEQ ID NO: 300 - protein, 112 aa, Artificial Sequence
  VH "MCSP M4-3 (D6)"
QVQLQESGPGLVKPSQTLSLTCTVSGGSITSGYYWNWIRQHPGKGLEWIGYITFDGKNNYNPSLKSRVTISRDTSKNQFSLKLSSVTAADTAVYYCADFDYWGQGTLVTVSS

SEQ ID NO: 301 - protein, 15 aa, Artificial Sequence
  VH CDR H2 " MCSP M4-3 (D6)"
ITFDGKNNYNPSLKS

SEQ ID NO: 302 - protein, 112 aa, Artificial Sequence
  VH "MCSP M4-3 (A7)"
QVQLQESGPGLVKPSQTLSLTCTVSGGSITDGYYWNWIRQHPGKGLEWIGYITFDGRNNYNPSLKSRVTISRDTSKNQFSLKLSSVTAADTAVYYCADFDYWGQGTLVTVSS

SEQ ID NO: 303 - protein, 6 aa, Artificial Sequence
  VH CDR H1 " MCSP M4-3 (A7)"
DGYYWN

SEQ ID NO: 304 - protein, 15 aa, Artificial Sequence
  VH CDR H2 " MCSP M4-3 (A7)"
ITFDGRNNYNPSLKS

SEQ ID NO: 305 - protein, 112 aa, Artificial Sequence
  VH "MCSP M4-3 (B7)"
QVQLQESGPGLVKPSQTLSLTCTVSGGSITSGYYWNWIRQHPGKGLEWIGYITFDGINNYNPSLKSRVTISRDTSKNQFSLKLSSVTAADTAVYYCADFDYWGQGTLVTVSS

SEQ ID NO: 306 - protein, 15 aa, Artificial Sequence
  VH CDR H2 " MCSP M4-3 (B7)"
ITFDGINNYNPSLKS

SEQ ID NO: 307 - protein, 112 aa, Artificial Sequence
  VH "MCSP M4-3 (B8)"
QVQLQESGPGLVKPSQTLSLTCTVSGGSITSGYYWNWIRQHPGKGLEWIGYITFDGRNNYNPSLKSRVTISRDTSKNQFSLKLSSVTAADTAVYYCADFDYWGQGTLVTVSS

SEQ ID NO: 308 - protein, 112 aa, Artificial Sequence; identical to SEQ ID NO: 239
  Parental VH MCSP M4-3

SEQ ID NO: 309 - protein, 107 aa, Artificial Sequence
  VL "MCSP ML2 (E10) "
DIQMTQSPSSLSASVGDRVTITCRASYGIRGYLNWYQQKPGKAPKLLIYYTSSLHSGVPSRFSGSGSGTDFTLTISSLQPEDFATYHCQQYSKLPWTFGQGTKVEIK

SEQ ID NO: 310 - protein, 11 aa, Artificial Sequence
  VL CDR L1 "MCSP ML2 (E10) "
RASYGIRGYLN

SEQ ID NO: 311 - protein, 9 aa, Artificial Sequence
  VL CDR L3 "MCSP ML2 (E10) "
QQYSKLPWT

SEQ ID NO: 312 - protein, 107 aa, Artificial Sequence
  VL "MCSP ML2 (E10-G3) "
DIQMTQSPSSLSASVGDRVTITCRASYGIRGYLNWYQQKPGKAPKLLIYYTSSLHSGVPSRFSGSGSGTDFTLTISSLQPEDFATYHCQQYSALPWTFGQGTKVEIK

SEQ ID NO: 313 - protein, 107 aa, Artificial Sequence
  VL "MCSP ML2 (C5) "
DIQMTQSPSSLSASVGDRVTITCRASRGIREYLNWYQQKPGKAPKLLIYYTGSLHSGVPSRFSGSGSGTDFTLTISSLQPEDFATYYCQQYSELPWTFGQGTKVEIK

SEQ ID NO: 314 - protein, 11 aa, Artificial Sequence
  VL CDR L1 "MCSP ML2 (C5) "
RASRGIREYLN

SEQ ID NO: 315 - protein, 7 aa, Artificial Sequence
  VL CDR L2 "MCSP ML2 (C5) "
YTGSLHS

SEQ ID NO: 316 - protein, 9 aa, Artificial Sequence
  VL CDR L3 "MCSP ML2 (C5)"
QQYSELPWT

SEQ ID NO: 317 - protein, 107 aa, Artificial Sequence
  VL "MCSP ML2 (C5-G3) "
DIQMTQSPSSLSASVGDRVTITCRASRGIREYLNWYQQKPGKAPKLLIYYTGSLHSGVPSRFSGSGSGTDFTLTISSLQPEDFATYYCQQYSALPWTFGQGTKVEIK

SEQ ID NO: 318 - protein, 107 aa, Artificial Sequence; identical to SEQ ID NO: 247
  Parental VL MCSP ML2

SEQ ID NO: 319 - protein, 214 aa, Artificial Sequence
  Light Chain humanized CD3 CH2527  (Crossfab, VL-CH1)
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 320 - protein, 685 aa, Artificial Sequence
  MCSP M4-3 (C1) (VH-CH1) - humanized CD3 CH2527 (Crossfab VH-Ck)-Fc(knob) P329GLALA
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 442 aa, Artificial Sequence
  MCSP M4-3 (C1) (VH-CH1)-Fc(hole) P329GLALA
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 322 - protein, 214 aa, Artificial Sequence; identical to SEQ ID NO: 319
  Light Chain humanized CD3 CH2527 (Crossfab, VL-CH1)

SEQ ID NO: 323 - protein, 694 aa, Artificial Sequence
  CEA CH1A1A 98/99 - humanized CD3 cH2527 (Crossfab VH-Ck)-Fc(knob) P329GLALA
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 324 - protein, 451 aa, Artificial Sequence; identical to SEQ ID NO: 65
  CEA CH1A1A 98/99 (VH-CH1)-Fc(hole) P329GLALA

SEQ ID NO: 325 - protein, 215 aa, Artificial Sequence
  Light Chain DP47 GS
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 214 aa, Artificial Sequence; identical to SEQ ID NO: 319
  Light Chain humanized CD3 cH2527 (Crossfab, VL-CH1)

SEQ ID NO: 327 - protein, 688 aa, Artificial Sequence
  DP47 GS (VH-CH1)  humanized CD3 CH2527 (Crossfab VH-Ck)Fc(knob) P329GLALA
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - protein, 445 aa, Artificial Sequence
  DP47 GS (VH-CH1)Fc(hole) P329GLALA
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 329 - DNA, 1425 bp, Artificial Sequence
  Heavy chain CD3 CH2527 (VH_3-23(12))
atgggatggagctgtatcatcctcttcttggtagcaacagctaccggtgtgcattccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcatctgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 330 - DNA, 705 bp, Artificial Sequence
  Light chain CD3 CH2527 (VL_7-46(13))
atgggatggagctgtatcatcctcttcttggtagcaacagctaccggtgtgcattctcaggccgtcgtgacccaggaacccagcctgacagtgtctcctggcggcaccgtgaccctgacatgtggcagttctacaggcgccgtgaccaccagcaactacgccaactgggtgcaggaaaagcccggccaggccttcagaggactgatcggcggcaccaacaagagagcccctggcacccctgccagattcagcggatctctgctgggaggaaaggccgccctgacactgtctggcgcccagccagaagatgaggccgagtactactgcgccctgtggtacagcaacctgtgggtgttcggcggaggcaccaagctgacagtcctaggtcaacccaaggctgcccccagcgtgaccctgttcccccccagcagcgaggaactgcaggccaacaaggccaccctggtctgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggagaaaaccgtggcccccaccgagtgcagctga

SEQ ID NO: 331 - DNA, 432 bp, Artificial Sequence
  VH CD3 CH2527 (VH_3-23(12))
atgggatggagctgtatcatcctcttcttggtagcaacagctaccggtgtgcattccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcatct

SEQ ID NO: 332 - DNA, 15 bp, Artificial Sequence
  VH CDR H1 CD3 CH2527 (VH_3-23(12))
acctacgccatgaac

SEQ ID NO: 333 - DNA, 57 bp, Artificial Sequence
  VH CDR H2 CD3 CH2527 (VH_3-23(12))
cggatcagaagcaagtacaacaactacgccacctactacgccgacagcgtgaagggc

SEQ ID NO: 334 - DNA, 42 bp, Artificial Sequence; identical to SEQ ID NO: 254
  VH CDR H3 CD3 CH2527 (VH_3-23(12))

SEQ ID NO: 335 - DNA, 384 bp, Artificial Sequence
  VL CD3 CH2527 (VL_7-46(13))
atgggatggagctgtatcatcctcttcttggtagcaacagctaccggtgtgcattctcaggccgtcgtgacccaggaacccagcctgacagtgtctcctggcggcaccgtgaccctgacatgtggcagttctacaggcgccgtgaccaccagcaactacgccaactgggtgcaggaaaagcccggccaggccttcagaggactgatcggcggcaccaacaagagagcccctggcacccctgccagattcagcggatctctgctgggaggaaaggccgccctgacactgtctggcgcccagccagaagatgaggccgagtactactgcgccctgtggtacagcaacctgtgggtgttcggcggaggcaccaagctgacagtccta

SEQ ID NO: 336 - DNA, 42 bp, Artificial Sequence
  VL CDR L1 CD3 CH2527 (VL_7-46(13))
ggcagttctacaggcgccgtgaccaccagcaactacgccaac

SEQ ID NO: 337 - DNA, 21 bp, Artificial Sequence
  VL CDR L2 CD3 CH2527 (VL_7-46(13))
ggcaccaacaagagagcccct

SEQ ID NO: 338 - DNA, 27 bp, Artificial Sequence
  VL CDR L3 CD3 CH2527 (VL_7-46(13))
gccctgtggtacagcaacctgtgggtg

SEQ ID NO: 339 - DNA, 1386 bp, Artificial Sequence
  Heavy chain MCSP M4-3 (C1)
atgggatggagctgtatcatcctcttcttggtagcaacagctaccggtgtgcattcccaggtgcaattgcaggaaagcggccctggcctggtcaagcccagccagaccctgagcctgacctgcaccgtgtccggcggcagcatcaccagcggctattattggaactggattcggcagcaccccggcaagggcctggaatggatcggctacatcactttcgacggctctaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 340 - DNA, 702 bp, Artificial Sequence
  Light chain MCSP ML2 (G3)
atgggatggagctgtatcatcctcttcttggtagcaacagctaccggtgtgcattccgacatccagatgacccagagccccagcagcctgagcgccagcgtgggcgacagagtgaccatcacctgccgggccagccagggcatccggaactacctgaactggtatcagcagaagcccggcaaggcccccaagctgctgatctactacaccagcagcctgcacagcggcgtgcctagccggtttagcggcagcggctccggcaccgactacaccctgaccattagctccctgcagcccgaggacttcgccacctactactgccagcagtactctgctctgccgtggaccttcggccagggaacaaaggtggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 341 - DNA, 393 bp, Artificial Sequence
  VH  MCSP M4-3 (C1)
atgggatggagctgtatcatcctcttcttggtagcaacagctaccggtgtgcattcccaggtgcaattgcaggaaagcggccctggcctggtcaagcccagccagaccctgagcctgacctgcaccgtgtccggcggcagcatcaccagcggctattattggaactggattcggcagcaccccggcaagggcctggaatggatcggctacatcactttcgacggctctaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagc

SEQ ID NO: 342 - DNA, 18 bp, Artificial Sequence
  VH CDR H1  MCSP M4-3 (C1)
agcggctattattggaac

SEQ ID NO: 343 - DNA, 48 bp, Artificial Sequence
  VH CDR H2  MCSP M4-3 (C1)
tacatcactttcgacggctctaacaactacaaccccagcctgaagtcc

SEQ ID NO: 344 - DNA, 9 bp, Artificial Sequence
  VH CDR H3  MCSP M4-3 (C1)
ttcgactac

SEQ ID NO: 345 - DNA, 378 bp, Artificial Sequence
  VL MCSP ML2 (G3)
atgggatggagctgtatcatcctcttcttggtagcaacagctaccggtgtgcattccgacatccagatgacccagagccccagcagcctgagcgccagcgtgggcgacagagtgaccatcacctgccgggccagccagggcatccggaactacctgaactggtatcagcagaagcccggcaaggcccccaagctgctgatctactacaccagcagcctgcacagcggcgtgcctagccggtttagcggcagcggctccggcaccgactacaccctgaccattagctccctgcagcccgaggacttcgccacctactactgccagcagtactctgctctgccgtggaccttcggccagggaacaaaggtggagatcaag

SEQ ID NO: 346 - DNA, 33 bp, Artificial Sequence; identical to SEQ ID NO: 242
  VL CDR L1 MCSP ML2 (G3)

SEQ ID NO: 347 - DNA, 22 bp, Artificial Sequence
  VL CDR L2 MCSP ML2 (G3)
tacaccagcagcctgcacagcg

SEQ ID NO: 348 - DNA, 27 bp, Artificial Sequence
  VL CDR L3 MCSP ML2 (G3)
cagcagtactctgctctgccgtggacc

SEQ ID NO: 349 - DNA, 1413 bp, Artificial Sequence
  Heavy chain CEA CH1A1A 98-99
atgggatggagctgtatcatcctcttcttggtagcaacagctaccggtgtgcattcccaggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 350 - DNA, 714 bp, Artificial Sequence
  Light chain CEA 2F1
atggacatgagggtccccgctcagctcctgggcctcctgctgctctggttcccaggtgccaggtgtgatatccagatgacccagtctccatcctccctgtctgcatctgtgggagacagagtcaccatcacttgcaaggccagtgcggctgtgggtacgtatgttgcgtggtatcagcagaaaccagggaaagcacctaagctcctgatctattcggcatcctaccgcaaaaggggagtcccatcaaggttcagtggcagtggatctgggacagatttcactctcaccatcagcagtctgcaacctgaagatttcgcaacttactactgtcaccaatattacacctatcctctattcacgtttggccagggcaccaagctcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 351 - DNA, 420 bp, Artificial Sequence
  VH CEA CH1A1A 98-99
atgggatggagctgtatcatcctcttcttggtagcaacagctaccggtgtgcattcccaggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagc

SEQ ID NO: 352 - DNA, 15 bp, Artificial Sequence
  VH CDR H1 CEA CH1A1A 98-99
gagttcggcatgaac

SEQ ID NO: 353 - DNA, 51 bp, Artificial Sequence; identical to SEQ ID NO: 120
  VH CDR H2 CEA CH1A1A 98-99

SEQ ID NO: 354 - DNA, 36 bp, Artificial Sequence; identical to SEQ ID NO: 122
  VH CDR H3 CEA CH1A1A 98-99

SEQ ID NO: 355 - DNA, 324 bp, Artificial Sequence; identical to SEQ ID NO: 132
  VL CEA 2F1

SEQ ID NO: 356 - DNA, 33 bp, Artificial Sequence; identical to SEQ ID NO: 126
  VL CDR L1 CEA 2F1

SEQ ID NO: 357 - DNA, 21 bp, Artificial Sequence
  VL CDR L2 CEA 2F1
tcggcatcctaccgcaaaagg

SEQ ID NO: 358 - DNA, 30 bp, Artificial Sequence; identical to SEQ ID NO: 130
  VL CDR L3 CEA 2F1

SEQ ID NO: 359 - DNA, 702 bp, Artificial Sequence
  Light Chain humanized CD3 CH2527  (Crossfab, VL-CH1)
atgggatggagctgtatcatcctcttcttggtagcaacagctaccggtgtgcattctcaggccgtcgtgacccaggaacccagcctgacagtgtctcctggcggcaccgtgaccctgacatgtggcagttctacaggcgccgtgaccaccagcaactacgccaactgggtgcaggaaaagcccggccaggccttcagaggactgatcggcggcaccaacaagagagcccctggcacccctgccagattcagcggatctctgctgggaggaaaggccgccctgacactgtctggcgcccagccagaagatgaggccgagtactactgcgccctgtggtacagcaacctgtgggtgttcggcggaggcaccaagctgacagtgctgagcagcgcttccaccaaaggcccttccgtgtttcctctggctcctagctccaagtccacctctggaggcaccgctgctctcggatgcctcgtgaaggattattttcctgagcctgtgacagtgtcctggaatagcggagcactgacctctggagtgcatactttccccgctgtgctgcagtcctctggactgtacagcctgagcagcgtggtgacagtgcccagcagcagcctgggcacccagacctacatctgcaacgtgaaccacaagcccagcaacaccaaggtggacaagaaggtggaacccaagtcttgttga

SEQ ID NO: 360 - DNA, 2115 bp, Artificial Sequence
  MCSP M4-3 (C1) (VH-CH1)  humanized CD3 CH2527 (Crossfab VH-Ck)Fc(knob) P329GLALA
atgggatggagctgtatcatcctcttcttggtagcaacagctaccggtgtgcattcccaggtgcaattgcaggaaagcggccctggcctggtcaagcccagccagaccctgagcctgacctgcaccgtgtccggcggcagcatcaccagcggctattattggaactggattcggcagcaccccggcaagggcctggaatggatcggctacatcactttcgacggctctaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcacaaagggccccagcgtgttccctctggcccctagcagcaagagcacatctggcggaacagccgccctgggctgcctcgtgaaggactactttcccgagcctgtgaccgtgtcctggaactctggcgccctgacaagcggcgtgcacacctttccagccgtgctgcagagcagcggcctgtactctctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 361 - DNA, 1386 bp, Artificial Sequence
  MCSP M4-3 (C1) (VH-CH1)Fc(hole) P329GLALA
atgggctggtcctgcatcatcctgtttctggtggctaccgccactggagtgcattcccaggtgcaattgcaggaaagcggccctggcctggtcaagcccagccagaccctgagcctgacctgcaccgtgtccggcggcagcatcaccagcggctattattggaactggattcggcagcaccccggcaagggcctggaatggatcggctacatcactttcgacggctctaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 362 - DNA, 702 bp, Artificial Sequence; identical to SEQ ID NO: 359
  Light Chain humanized  CD3 CH2527 (Crossfab, VL-CH1)

SEQ ID NO: 363 - DNA, 2142 bp, Artificial Sequence
  CEA CH1A1A 98/99  humanized CD3 CH2527 (Crossfab VH-Ck)Fc(knob) P329GLALA
atgggatggagctgtatcatcctcttcttggtagcaacagctaccggtgtgcattcccaggtgcagctggtgcagtctggcgccgaagtgaagaaacctggcgccagcgtgaaggtgtcctgcaaggccagcggctacaccttcaccgagttcggcatgaactgggtccgacaggcccctggacagggcctggaatggatgggctggatcaacaccaagaccggcgaggccacctacgtggaagagttcaagggcagagtgaccttcaccaccgacaccagcaccagcaccgcctacatggaactgcggagcctgagaagcgacgacaccgccgtgtactactgcgccagatgggacttcgcctactatgtggaagccatggactactggggccagggcaccaccgtgaccgtgtctagtgctagcacaaagggccccagcgtgttccctctggcccctagcagcaagagcacatctggcggaacagccgccctgggctgcctggtcaaggactactttcccgagcccgtgacagtgtcctggaactctggcgccctgacaagcggcgtgcacacctttccagccgtgctgcagagcagcggcctgtactctctgagcagcgtggtcaccgtgcctagctctagcctgggcacccagacctacatctgcaacgtgaaccacaagcccagcaacaccaaggtggacaagaaggtggaacccaagagctgcgatggcggaggcggctccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 364 - DNA, 1413 bp, Artificial Sequence
  CEA CH1A1A 98/99 (VH-CH1)Fc(hole) P329GLALA
atgggatggagctgtatcatcctcttcttggtagcaacagctaccggtgtgcattcccaggtgcagctggtgcagtctggcgccgaagtgaagaaacctggagctagtgtgaaggtgtcctgcaaggccagcggctacaccttcaccgagttcggcatgaactgggtccgacaggctccaggccagggcctcgaatggatgggctggatcaacaccaagaccggcgaggccacctacgtggaagagttcaagggcagagtgaccttcaccacggacaccagcaccagcaccgcctacatggaactgcggagcctgagaagcgacgacaccgccgtgtactactgcgccagatgggacttcgcctattacgtggaagccatggactactggggccagggcaccaccgtgaccgtgtctagcgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 365 - DNA, 705 bp, Artificial Sequence
  Light Chain DP47 GS
atgggatggagctgtatcatcctcttcttggtagcaacagctaccggtgtgcattccgaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 366 - DNA, 702 bp, Artificial Sequence; identical to SEQ ID NO: 359
  Light Chain humanized CD3 CH2527 (Crossfab, VL-CH1)

SEQ ID NO: 367 - DNA, 2124 bp, Artificial Sequence
  DP47 GS (VH-CH1)  humanized CD3 CH2527 (Crossfab VH-Ck)Fc(knob) P329GLALA
atgggatggagctgtatcatcctcttcttggtagcaacagctaccggtgtgcattccgaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcacaaagggccccagcgtgttccctctggcccctagcagcaagagcacatctggcggaacagccgccctgggctgcctcgtgaaggactactttcccgagcctgtgaccgtgtcctggaactctggcgccctgacaagcggcgtgcacacctttccagccgtgctgcagagcagcggcctgtactctctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 368 - DNA, 1395 bp, Artificial Sequence
  DP47 GS (VH-CH1)Fc(hole) P329GLALA
atgggatggagctgtatcatcctcttcttggtagcaacagctaccggtgtgcattccgaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 369 - protein, 214 aa, Artificial Sequence; identical to SEQ ID NO: 319
  Light Chain humanized CD3 CH2527 (Crossfab, VL-CH1)

SEQ ID NO: 370 - protein, 589 aa, Artificial Sequence
  aVH (MCSP)  humanized CD3 CH2527 (VH-CK)Fc(knob) P329GLALA
EVQLVESGGGLVQPGGSLRLSCAASGFNIKDTYIGWVRRAPGKGTELVARIYPTNGYTRYADSVKGRFTISADTSKNTAYLQMNSLRAEDTAVYYCARTSWGGWLSGDYWGQGTLVTVSSGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 347 aa, Artificial Sequence
  aVH (MCSP)  Fc(hole) P329GLALA
EVQLVESGGGLVQPGGSLRLSCAASGFNIKDTYIGWVRRAPGKGTELVARIYPTNGYTRYADSVKGRFTISADTSKNTAYLQMNSLRAEDTAVYYCARTSWGGWLSGDYWGQGTLVTVSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 372 - protein, 214 aa, Artificial Sequence; identical to SEQ ID NO: 278
  Light chain "MCSP ML2 (G3)"

SEQ ID NO: 373 - protein, 214 aa, Artificial Sequence; identical to SEQ ID NO: 319
  Light chain humanized CD3 CH2527 (Crossfab, VL-CH1)

SEQ ID NO: 374 - protein, 685 aa, Artificial Sequence
  MCSP M4-3(C1)  humanized CD3 CH2527 (VH-CK)  Fc(DD) P329GLALA
QVQLQESGPGLVKPSQTLSLTCTVSGGSITSGYYWNWIRQHPGKGLEWIGYITFDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 375 - protein, 442 aa, Artificial Sequence
  MCSP M4-3(C1)  Fc(KK) P329GLALA
QVQLQESGPGLVKPSQTLSLTCTVSGGSITSGYYWNWIRQHPGKGLEWIGYITYDGSNNYNPSLKSRVTISRDTSKNQFSLKLSSVTAADTAVYYCADFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRKELTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 376 - protein, 214 aa, Artificial Sequence; identical to SEQ ID NO: 319
  Light chain humanized CD3 CH2527 (Crossfab, VL-CH1)

SEQ ID NO: 377 - protein, 592 aa, Artificial Sequence
  Darpin (HER2)  humanized CD3 CH2527 (VH-CK)  Fc(knob) P329GLALA
DLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLGGGGSGGGGSEVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 350 aa, Artificial Sequence
  Darpin (HER2)  Fc(hole) P329GLALA
DLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 379 - DNA, 702 bp, Artificial Sequence; identical to SEQ ID NO: 359
  Light chain humanized CD3 CH2527 (Crossfab, VL-CH1)

SEQ ID NO: 380 - DNA, 1827 bp, Artificial Sequence
  aVH (MCSP)  humanized CD3 CH2527 (VH-CK)  Fc(knob) P329GLALA
atgggatggagctgtatcatcctcttcttggtagcaacagctaccggtgtgcattccgaagttcagctggttgaaagcggtggtggtctggttcagcctggtggtagcctgcgtctgagctgtgcagcaagcggttttaatatcaaagatacctatattggttgggttcgtcgtgcaccgggtaaaggtaccgaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgcgtacttcttggggtggttggctgtctggtgactactggggccaaggaaccctggttactgtctcgagtggcggaggagggtccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 381 - DNA, 1101 bp, Artificial Sequence
  aVH (MCSP) Fc(hole) P329GLALA
atgggctggtcctgcatcatcctgtttctggtggctaccgccactggagtgcattccgaagttcagctggttgaaagcggtggtggtctggttcagcctggtggtagcctgcgtctgagctgtgcagcaagcggttttaatatcaaagatacctatattggttgggttcgtcgtgcaccgggtaaaggtaccgaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgcgtacttcttggggtggttggctgtctggtgactactggggccaaggaaccctggttactgtctcgagtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 382 - DNA, 702 bp, Artificial Sequence; identical to SEQ ID NO: 340
  Light chain MCSP ML2 (G3)

SEQ ID NO: 383 - DNA, 702 bp, Artificial Sequence; identical to SEQ ID NO: 359
  Light Chain humanized CD3 CH2527 (Crossfab, VL-CH1)

SEQ ID NO: 384 - DNA, 2115 bp, Artificial Sequence
  MCSP M4-3(C1)  humanized CD3 CH2527 (VH-CK)Fc(DD) P329GLALA
atgggatggagctgtatcatcctcttcttggtagcaacagctaccggtgtgcattcccaggtgcaattgcaggaaagcggccctggcctggtcaagcccagccagaccctgagcctgacctgcaccgtgtccggcggcagcatcaccagcggctattattggaactggattcggcagcaccccggcaagggcctggaatggatcggctacatcactttcgacggctctaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcacaaagggccccagcgtgttccctctggcccctagcagcaagagcacatctggcggaacagccgccctgggctgcctcgtgaaggactactttcccgagcctgtgaccgtgtcctggaactctggcgccctgacaagcggcgtgcacacctttccagccgtgctgcagagcagcggcctgtactctctgagcagcgtggtcaccgtgcctagcagcagcctgggcacccagacctacatctgcaacgtgaaccacaagcccagcaacaccaaagtggacaagaaggtggagcccaagagctgtgatggcggaggagggtccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctacagcgacctcaccgtggacaagagcaggtggcagcaggggaacgtcttctcatgctccgtgatgcatgaggctctgcacaaccactacacgcagaagagcctctccctgtctccgggtaaatga

SEQ ID NO: 385 - DNA, 1386 bp, Artificial Sequence
  MCSP M4-3(C1)  Fc(KK) P329GLALA
atgggctggtcctgcatcatcctgtttctggtggctaccgccactggagtgcattcccaggtgcagctgcaggaaagcggccctggcctggtcaagcccagccagaccctgagcctgacctgcaccgtgtccggcggcagcatcaccagcggctactactggaactggatccggcagcaccccggcaagggcctggaatggatcggctacatcacctacgacggcagcaacaactacaaccccagcctgaagtccagagtgaccatcagccgggacaccagcaagaaccagttcagcctgaagctgtccagcgtgacagccgccgacaccgccgtgtactactgcgccgacttcgactactggggccagggcaccctggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccggaaagagctgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 386 - DNA, 702 bp, Artificial Sequence; identical to SEQ ID NO: 359
  Light Chain humanized CD3 CH2527 (Crossfab, VL-CH1)

SEQ ID NO: 387 - DNA, 1836 bp, Artificial Sequence
  Darpin  (HER2)  humanized CD3 CH2527 (VH-CK)Fc(knob) P329GLALA
atgggatggagctgtatcatcctcttcttggtagcaacagctaccggtgtgcattccgatctgggcaagaagctgctggaagccgccagagccggccaggacgacgaagtgcggatcctgatggccaacggcgccgacgtgaacgccaaggacgagtacggcctgacccctctgtatctggccacagcccacggccacctggaaatcgtggaggtgctgctgaagaacggggccgatgtgaacgccgtggacgccatcggcttcacacctctgcacctggccgccttcatcggccacctcgagattgccgaggtcctgctgaaacatggcgctgacgtgaacgctcaggacaagttcggcaagaccgccttcgacatcagcatcggcaacggcaacgaggacctggccgagatcctgcagaagctgggcggaggagggtccggaggcggaggatccgaggtgcagctgctggaatctggcggcggactggtgcagcctggcggatctctgagactgagctgtgccgccagcggcttcaccttcagcacctacgccatgaactgggtgcgccaggcccctggcaaaggcctggaatgggtgtcccggatcagaagcaagtacaacaactacgccacctactacgccgacagcgtgaagggccggttcaccatcagccgggacgacagcaagaacaccctgtacctgcagatgaacagcctgcgggccgaggacaccgccgtgtactattgtgtgcggcacggcaacttcggcaacagctatgtgtcttggtttgcctactggggccagggcaccctcgtgaccgtgtcaagcgctagcgtggccgctccctccgtgtttatctttcccccatccgatgaacagctgaaaagcggcaccgcctccgtcgtgtgtctgctgaacaatttttaccctagggaagctaaagtgcagtggaaagtggataacgcactgcagtccggcaactcccaggaatctgtgacagaacaggactccaaggacagcacctactccctgtcctccaccctgacactgtctaaggctgattatgagaaacacaaagtctacgcctgcgaagtcacccatcagggcctgagctcgcccgtcacaaagagcttcaacaggggagagtgtgacaagacccacacctgtcccccttgtcctgcccctgaagctgctggcggcccttctgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 388 - DNA, 1110 bp, Artificial Sequence
  Darpin  (HER2) Fc(hole) P329GLALA
atgggatggagctgtatcatcctcttcttggtagcaacagctaccggtgtgcattccgatctgggcaagaagctgctggaagccgccagagccggccaggacgacgaagtgcggatcctgatggccaacggcgccgacgtgaacgccaaggacgagtacggcctgacccctctgtatctggccacagcccacggccacctggaaatcgtggaggtgctgctgaagaacggggccgatgtgaacgccgtggacgccatcggcttcacacctctgcacctggccgccttcatcggccacctcgagattgccgaggtcctgctgaaacatggcgctgacgtgaacgctcaggacaagttcggcaagaccgccttcgacatcagcatcggcaacggcaacgaggacctggccgagatcctgcagaagctggacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 389 - protein, 643 aa, Artificial Sequence
  D3 domain of cynomologus MCSP (extracellular part)
LSLEGSRTLTVCPGSVQPLSSQTLRASSSAGTDPQLLLYRVVRGPQLGRLFHAQQDSTGEALVNFTQAEVYAGNILYEHEMPTEPFWEAHDTLELQLSSPPARDVAATLAVAVSFEAACPQRPSHLWKNKGLWVPEGQRAKITMAALDASNLLASVPSPQRLEHDVLFQVTQFPSRGQLLVSEEPLHAGQPHFLQSQLAAGQLVYAHGGGGTQQDGFHFRAHLQGPAGATVAGPQTSEAFAITVRDVNERPPQPQASVPLRITRGSRAPISRAQLSVVDPDSAPGEIEYEVQRAPHNGFLSLVGGGPGPVTHFTQADVDSGRLAFVANGSSVAGVFQLSMSDGASPPLPMSLAVDILPSAIEVQLQAPLEVPQALGRSSLSQQQLRVVSDREEPEAAYRLIQGPKYGHLLVGGRPASAFSQLQIDQGEVVFAFTNFSSSHDHFRVLALARGVNASAVVNITVRALLHVWAGGPWPQGATLRLDPTILDAGELANRTGSVPHFRLLEGPRHGRVVRVPRARTEPGGSQLVEQFTQQDLEDGRLGLEVGRPEGRAPSPTGDSLTLELWAQGVPPAVASLDFATEPYNAARPYSVALLSVPEATRMEAGKPESSTPTGEPGPMASSPVPAVAKGGFLGFLEANMFS

SEQ ID NO: 390 - protein, 643 aa, Artificial Sequence
  D3 domain of human MCSP (extracellular part)
LSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQHPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFS

What is claimed is:

1. A T cell activating bispecific antigen-binding molecule comprising:
   (a) the polypeptide sequence of SEQ ID NO: 376, the polypeptide sequence of SEQ ID NO: 377, and the polypeptide sequence of SEQ ID NO: 378; or
   (b) the polypeptide encoded by the nucleic acid sequence of SEQ ID NO: 386, the polypeptide encoded by the nucleic acid sequence of SEQ ID NO: 387, and the polypeptide encoded by the nucleic acid sequence of SEQ ID NO: 388.

* * * * *